United States Patent
Clark et al.

(10) Patent No.: US 11,779,655 B2
(45) Date of Patent: Oct. 10, 2023

(54) AAV-ABCD1 CONSTRUCTS AND USE FOR TREATMENT OR PREVENTION OF ADRENOLEUKODYSTROPHY (ALD) AND/OR ADRENOMYELONEUROPATHY (AMN)

(71) Applicant: SwanBio Therapeutics Limited, London (GB)

(72) Inventors: Sean Clark, Princeton, NJ (US); Karen Kozarsky, Bala Cynwyd, PA (US); Tugba Guven-Ozkan, Plymouth Meeting, PA (US); Anna Tretiakova, Philadelphia, PA (US)

(73) Assignee: SwanBio Therapeutics Limited, London (GB)

( * ) Notice: Subject to any disclaimer, the term of this patent is extended or adjusted under 35 U.S.C. 154(b) by 0 days.

(21) Appl. No.: 17/557,409

(22) Filed: Dec. 21, 2021

(65) Prior Publication Data
US 2022/0175965 A1  Jun. 9, 2022
US 2022/0362403 A2  Nov. 17, 2022

Related U.S. Application Data

(63) Continuation of application No. PCT/US2020/067664, filed on Dec. 31, 2020.

(60) Provisional application No. 62/955,667, filed on Dec. 31, 2019.

(51) Int. Cl.
*A61K 48/00* (2006.01)
*A61K 9/00* (2006.01)
*C12N 15/86* (2006.01)

(52) U.S. Cl.
CPC .......... *A61K 48/005* (2013.01); *A61K 9/0019* (2013.01); *C12N 15/86* (2013.01); *C12N 2800/107* (2013.01)

(58) Field of Classification Search
CPC .... A61K 48/005; A61K 9/0019; C12N 15/86; C12N 2800/107; C12N 2750/14143; C12N 2830/48; C07K 14/4702
See application file for complete search history.

(56) References Cited

U.S. PATENT DOCUMENTS

| | | | | |
|---|---|---|---|---|
| 2014/0017201 A1* | 1/2014 | Choi | ............. | A61K 48/005 435/456 |
| 2015/0010578 A1* | 1/2015 | Balazs | ............. | C07K 16/109 424/160.1 |
| 2015/0315610 A1* | 11/2015 | Nishie | ............. | C07K 14/005 435/235.1 |
| 2018/0094280 A1 | 4/2018 | Kutner et al. | | |
| 2018/0311290 A1* | 11/2018 | Sena-Esteves | ....... | C12N 9/2471 |
| 2021/0386871 A1* | 12/2021 | Orlans | ............. | C07K 14/435 |

FOREIGN PATENT DOCUMENTS

| | | | | |
|---|---|---|---|---|
| WO | WO-2010010107 A1 * | 1/2010 | | |
| WO | WO-2012170911 A2 * | 12/2012 | ............. | A61K 35/28 |
| WO | WO-2015153889 A2 * | 10/2015 | | |
| WO | WO 2017/079467 A1 | 5/2017 | | |
| WO | WO-2017137585 A1 * | 8/2017 | | |
| WO | WO-2018136434 A1 * | 7/2018 | | |
| WO | WO-2018165536 A1 * | 9/2018 | | |
| WO | WO-2019060649 A1 * | 3/2019 | | |
| WO | WO-2019079437 A1 * | 4/2019 | | |

OTHER PUBLICATIONS

Naso et al. "Adeno-Associated Virus (AAV) as a Vector for Gene Therapy." BioDrugs. Aug. 2017;31(4):317-33 (Year: 2017).*
Barnard et al. "Gene therapy for choroideremia using an adeno-associated viral (AAV) vector." Cold Spring Harb Perspect Med. Oct. 30, 2014;5(3):a017293. (Year: 2014).*
Van Ooyen et al. "Comparison of total sequence of a cloned rabbit beta-globin gene and its flanking regions with a homologous mouse sequence." Science. Oct. 19, 1979;206(4416):337-44. (Year: 1979).*
International Search Report and Written Opinion dated Apr. 26, 2021 for Application No. PCT/US2020/067664.
[No Author Listed] Genbank Submission; NIH/NCBI, Accession No. NM_000033. Le et al., Feb. 20, 2022. 6 pages.
[No Author Listed] Genbank Submission; NIH/NCBI, Accession No. NM_000033.4. Le et al., Feb. 20, 2022. 6 pages.
Gong et al., Adenoassociated virus serotype 9-mediated gene therapy for x-linked adrenoleukodystrophy. Mol Ther. May 2015;23(5):824-834. Epub Jan. 16, 2015.
Gong et al., Intrathecal adeno-associated viral vector-mediated gene delivery for adrenomyeloneuropathy. Hum Gene Ther. May 2019; 30(5):544-555. Epub Dec. 18, 2018.

* cited by examiner

*Primary Examiner* — Titilayo Moloye
(74) *Attorney, Agent, or Firm* — Wolf, Greenfield & Sacks, P.C.

(57) ABSTRACT

The present disclosure generally relates to polynucleotides and AAV vectors that provide for the expression of ALD protein in target (e.g., neurons or glial) cells when administered to subjects in need thereof. The present disclosure further relates to compositions comprising such a polynucleotide or vector. These polynucleotides, vectors, and compositions may be used for the treatment and prevention of ALD or AMN in subjects in need thereof.

15 Claims, 34 Drawing Sheets
Specification includes a Sequence Listing.

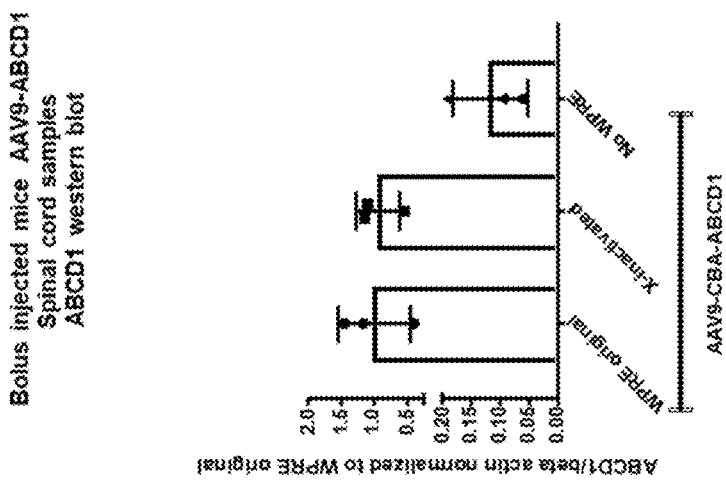
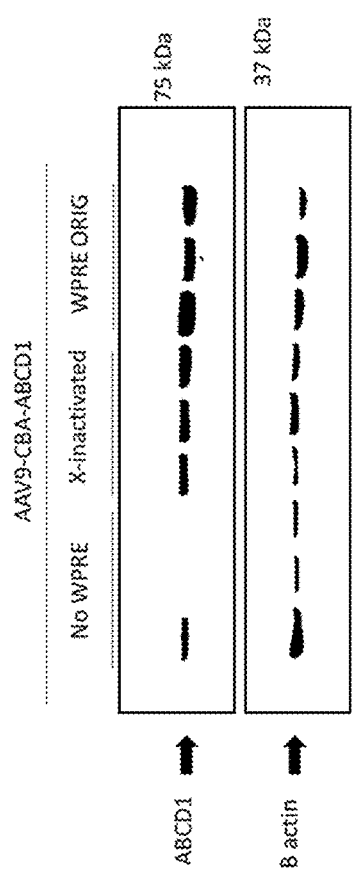
FIGURE 1A
FIGURE 1B

Western Blot Data – *In Vivo* (n=2)

1e11 gc dose
15 second exposure

3e11 gc dose
2 second exposure

3e11 gc dose
15 second exposure

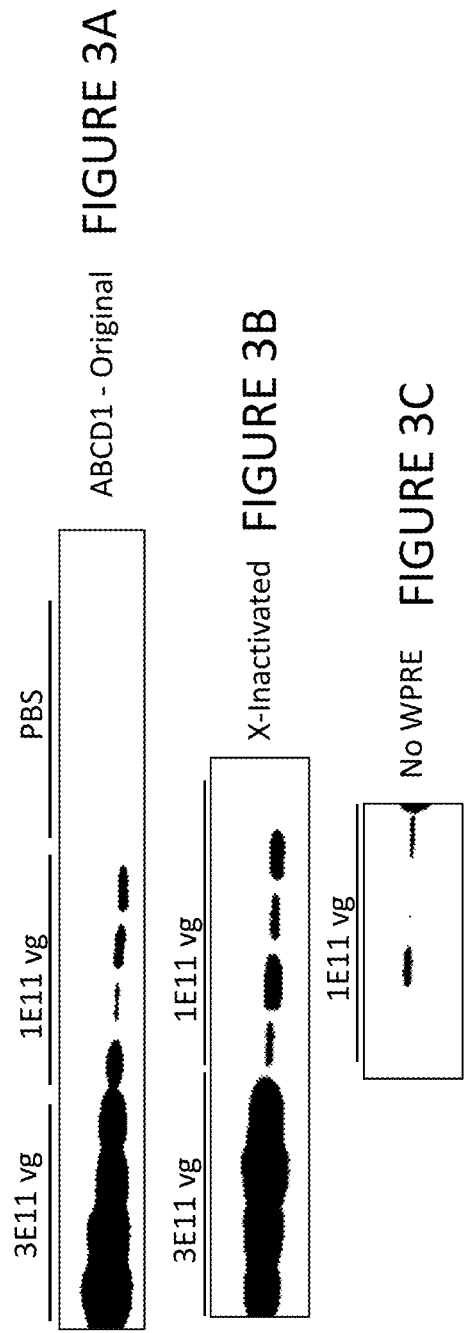

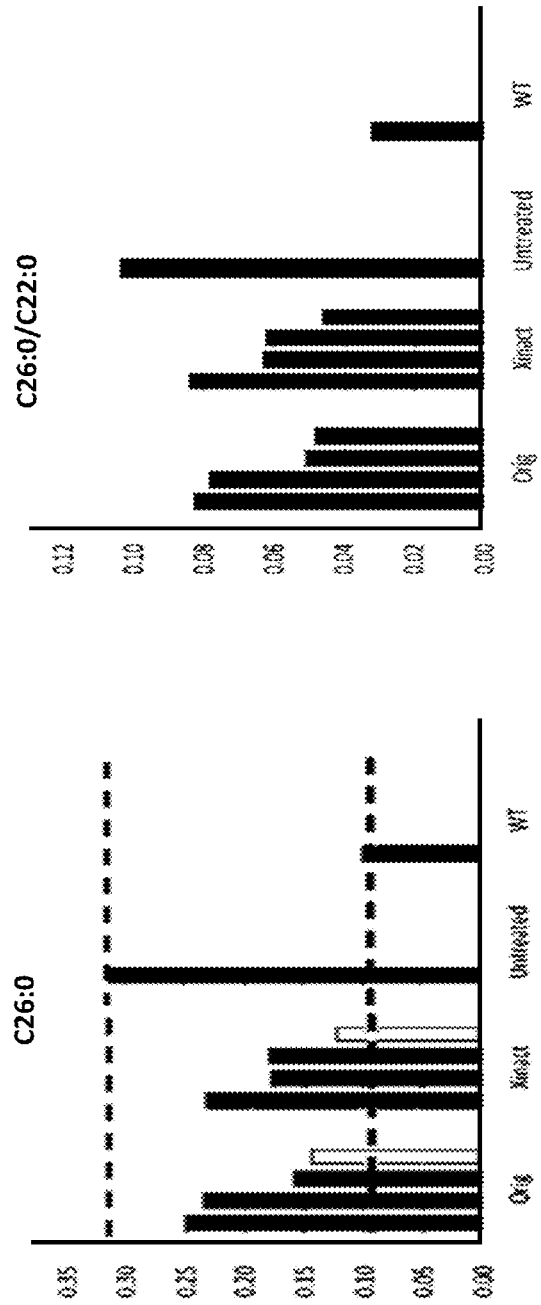

Assessment of Packageability into AAV of Original & Improved AAV Constructs

| Titer & productivity | Cell lysates pSBT101 | Cell lysates pOB1005 | Supernatant pSBT101 | Supernatant pOB1005 |
|---|---|---|---|---|
| Titer, gc/ml | 1.10E+11 | 2.85E+11 | 3.29E+08 | 1.08E+09 |
| Productivity, gc/cell | 1.23E+05 | 3.17E+05 | 3.66E+03 | 1.20E+04 |
| Yield, gc | 5.50E+09 | 1.43E+10 | 1.65E+08 | 5.40E+08 |

| Total Yield | pSBT101 | pOB1005 |
|---|---|---|
| gc | 5.66E+09 | 1.48E+10 |

FIGURE 9

| Construct segment name | rAAV Genome Vector for AAV-CBA-hABCD1-WPRE | rAAV Genome Vector for AAV-CBA-hABCD1-WPRE Xinact | rAAV Genome Vector for AAV-CBA-hABCD1 [no WPRE] |
|---|---|---|---|
| full plasmid | 9900 | 10000 | 10200 |
| 5' ITR | 9901 | 10001 | 10201 |
| CMV enhancer | 9905 | 10005 | 10205 |
| chicken beta-actin promoter | 9907 | 10007 | 10207 |
| beta actin exon | 9908 | 10008 | 10208 |
| chimeric intron | 9909 | 10009 | 10209 |
| rabbit beta globin exon | 9985 | 10085 | 10285 |
| hABCD1 5' UTR | 9910 | 10010 | |
| KOZAK sequence | | | |
| hABCD1 | 9912 | 10012 | 10212 |
| Terminator 1 | 9971 | 10071 | 10271 |
| Terminator 2 | | | |
| hABCD1 3' UTR | 9913 | 10013 | |
| WPRE | 9975 | 10075 | |
| SV40 polyA signal | 9914 | 10014 | 10214 |
| bGH polyA signal | 9916 | 10016 | 10216 |
| Total polyA signal (SV40pA to bGHpA) | 9935 | 10035 | 10235 |
| 3' ITR | 9918 | 10018 | 10218 |
| 5' ITR to 3' ITR | 9950 | 10050 | 10250 |
| rAAV vector genome (5'end to 3' end) | 9960 | 10060 | 10260 |

Elements between 5' ITR to 3' ITR

FIGURE 10B

SEQ ID NOs

| Construc segment name | pSBT101 | pOB1005 | pOB1010 | pOB1011 | pOB1012 | pOB1013 | pOB1015 | pOB1017 |
|---|---|---|---|---|---|---|---|---|
| full plasmid | 10100 | 10500 | 11000 | 11100 | 11200 | 11300 | 11500 | 11700 |
| 5' ITR | 10101 | 10501 | 11001 | 11101 | 11201 | 11301 | 11501 | 11701 |
| CMV enhancer | 10105 | 10505 | 11005 | 11105 | 11205 | 11305 | 11505 | 11705 |
| chicken beta-actin promoter | 10107 | 10507 | 11007 | 11107 | 11207 | 11307 | 11507 | 11707 |
| beta actin exon | 10108 | 10508 | 11008 | 11108 | 11208 | 11308 | 11508 | 11708 |
| chimeric intron | 10109 | 10509 | 11009 | 11109 | 11209 | 11309 | 11509 | 11709 |
| rabbit beta globin exon | 10185 | 10585 | 11085 | 11185 | 11285 | 11385 | 11585 | 11785 |
| hABCD1 5' UTR | 10110 | | 11010 | 11110 | | | 11510 | 11710 |
| KOZAK sequence | | 10511 | | | 11211 | 11311 | | |
| hABCD1 | 10112 | 10512 | 11012 | 11112 | 11212 | 11312 | 11512 | 11712 |
| Terminator 1 | 10171 | 10571 | 11071 | 11171 | 11271 | 11371 | 11571 | 11771 |
| Terminator 2 | | 10572 | | | 11272 | 11372 | | |
| hABCD1 3' UTR | 10113 | | 11013 | 11113 | | | 11513 | 11713 |
| SV40 polyA signal | 10114 | 10514 | 11014 | | 11214 | | | 11714 |
| bGH polyA signal | 10116 | | 11016 | 11116 | 11216 | 11316 | 11516 | 11716 |
| Total polyA signal (SV40pA to bGHpA) | 10135 | | 11035 | | 11235 | | | 11735 |
| 3' ITR | 10118 | 10518 | 11018 | 11118 | 11218 | 11318 | 11518 | 11718 |
| 5' ITR to 3' ITR | 10150 | 10550 | 11050 | 11150 | 11250 | 11350 | 11550 | 11750 |
| rAAV vector genome (5'end to 3' end) | 10160 | 10560 | 11060 | 11160 | 11260 | 11360 | 11560 | 11760 |

Elements between 5' ITR to 3' ITR

FIGURE 12B

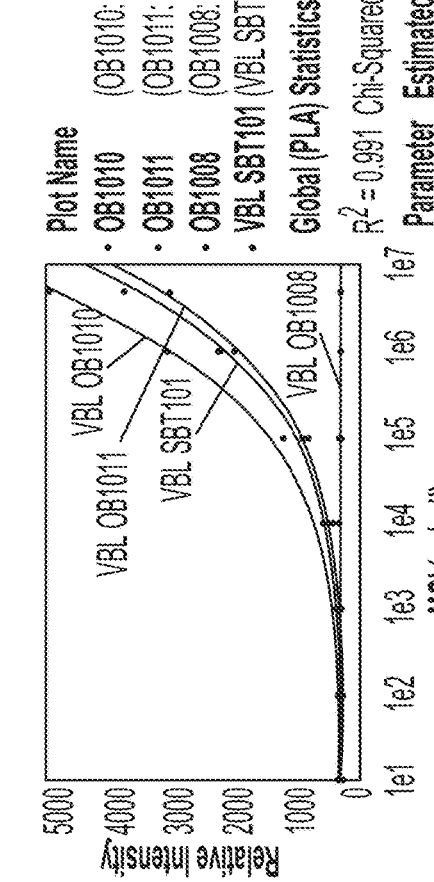
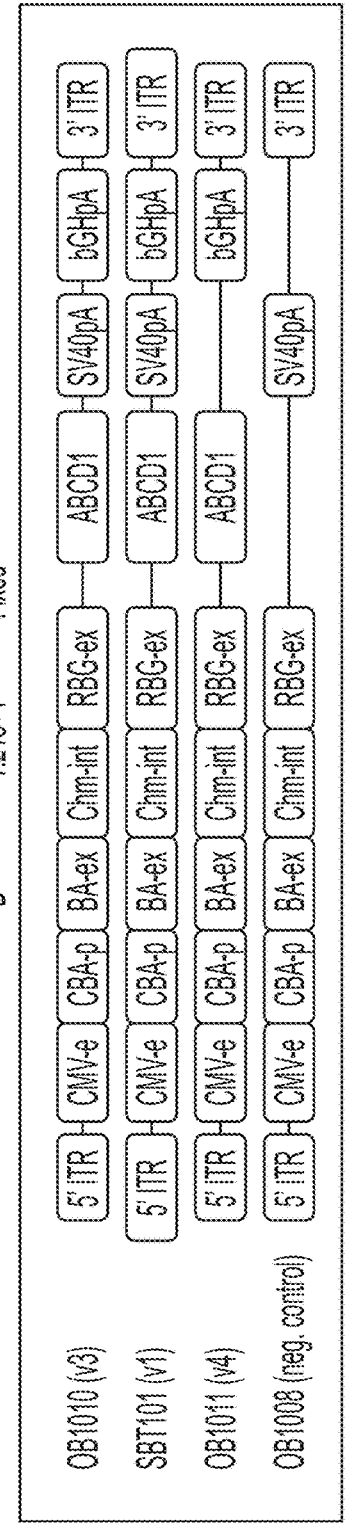
FIGURE 13A

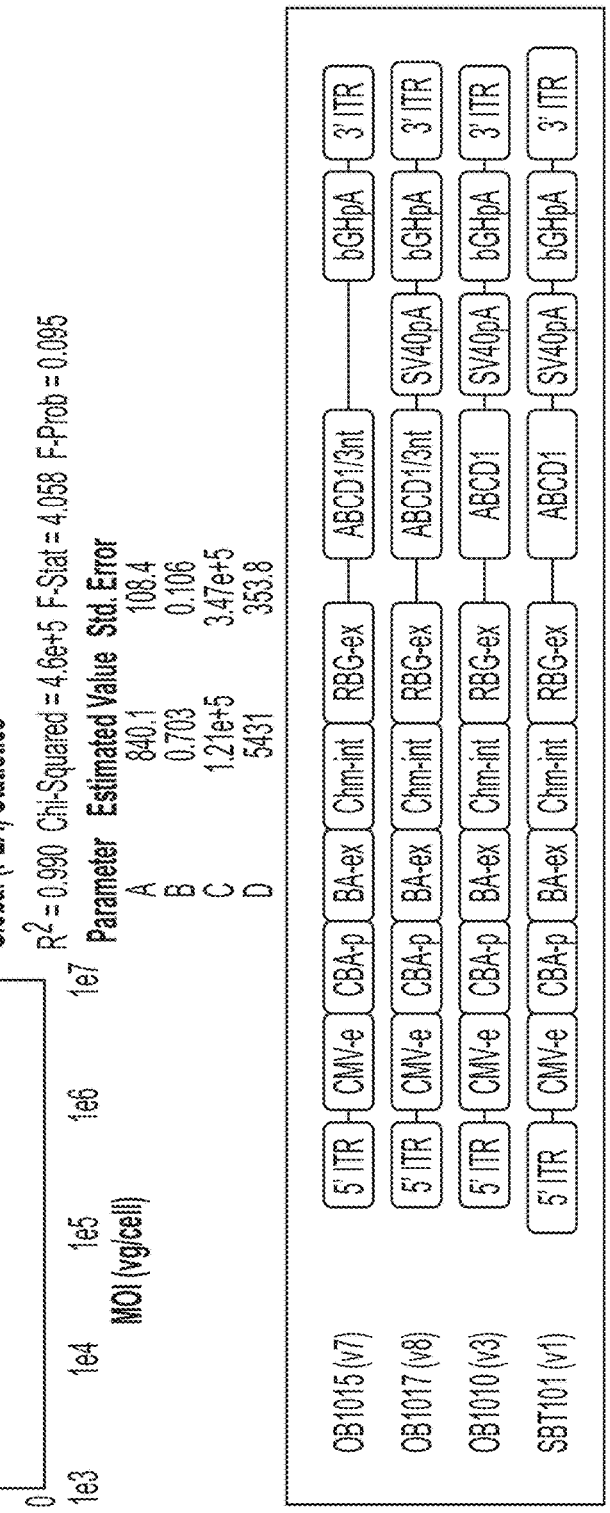
FIGURE 13D

|  | SBT101 | | VBL OB1010 | | VBL OB1015 | | VBL OB1017 | |
|---|---|---|---|---|---|---|---|---|
| MOI | Rel. Int. | %CV | Rel. Int. | %CV | Rel. Int. | %CV | Rel. Int. | %CV |
| NTC | 808.4 | 2.6% | 808.4 | 2.6% | 808.4 | 2.6% | 808.4 | 2.6% |
| 1.00E+03 | 800.9 | 1.5% | 854.1 | 3.2% | 901.4 | 2.1% | 938.1 | 0.1% |
| 1.00E+04 | 1055.5 | 2.8% | 1178.8 | 1.0% | 1234.3 | 0.7% | 1242.4 | 3.1% |
| 1.00E+05 | 1670.6 | #DIV/0! | 1936.5 | 0.3% | 2180.6 | 0.4% | 2107.6 | 3.1% |
| 1.00E+06 | 3170.0 | 0.9% | 3884.9 | 0.6% | 4353.3 | 2.2% | 4055.2 | 1.2% |
| 5.00E+06 | 3844.8 | 4.0% | 4693.5 | 0.5% | 5175.2 | 1.4% | 4544.7 | 2.1% |

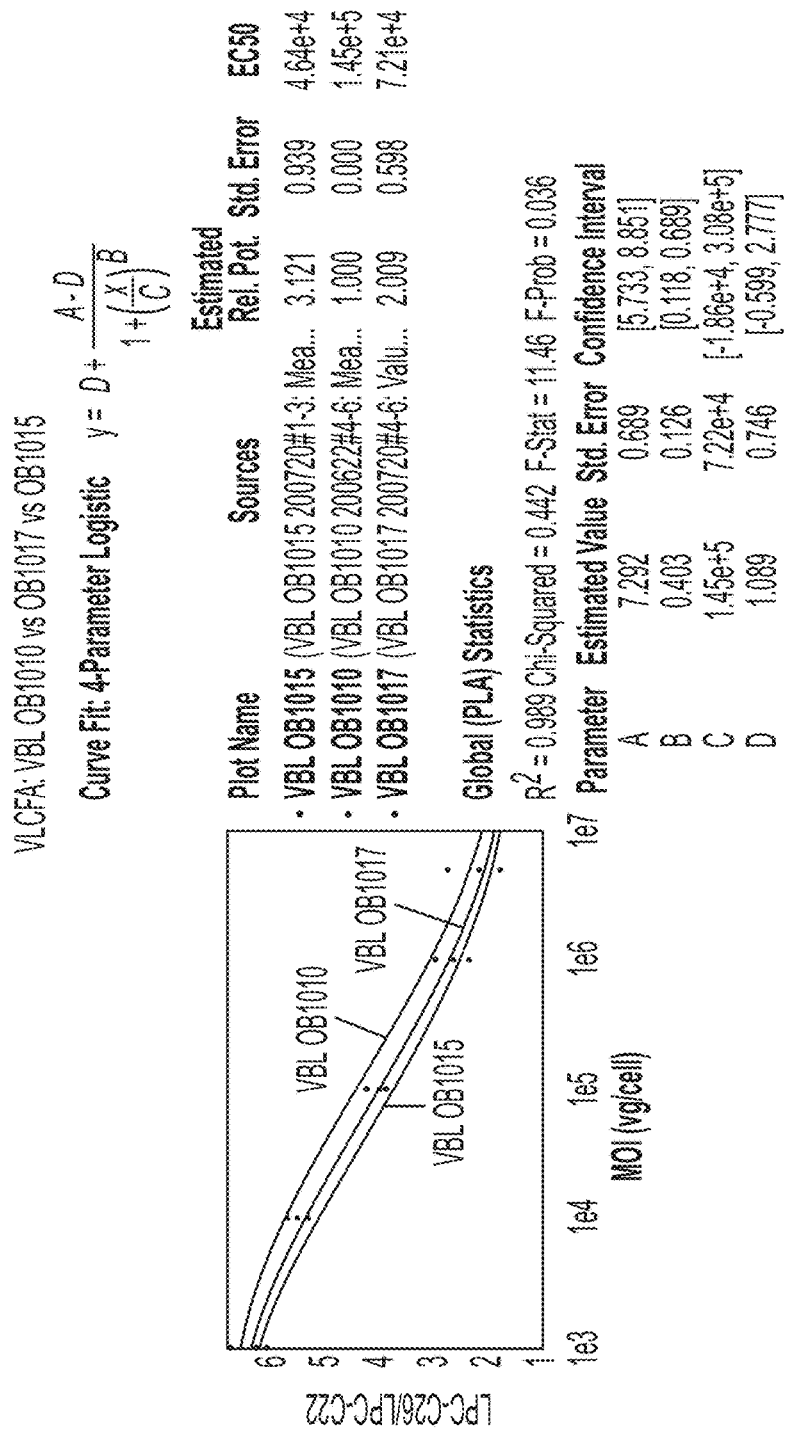
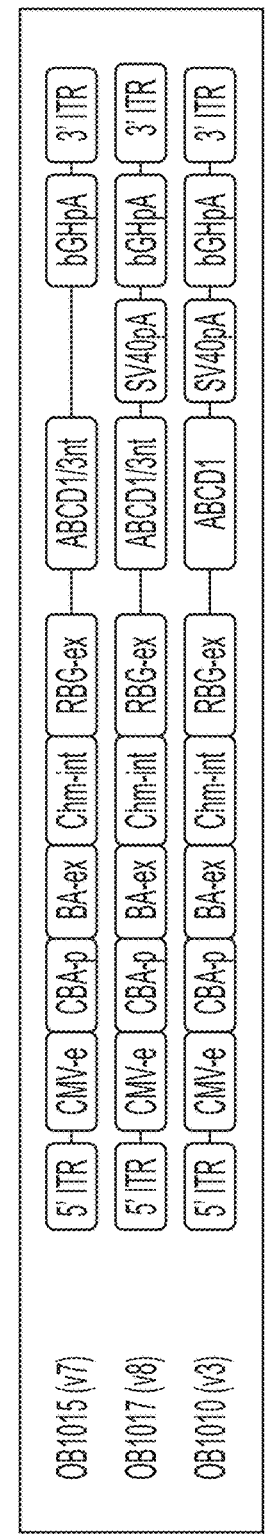
FIGURE 14

| rAAV Viral Vector | Plasmid | vg Titer (vg/mL) ddPCR GOI (*ddPCR SV40) | vg Titer (vg/mL) qPCR CMVe |
|---|---|---|---|
| OB1010 | pOB1010 | 3.12E+11 | 5.59E+12 |
| SBT101 | pSBT101 (i.e., pAAV.CBA.hABCD1.KanR) | 2.72E+11 | 3.99E+12 |
| OB1008 | pOB1008 | 3.52E+12 | 2.21E+13 |

FIGURE 17

AAV-ABCD1 CONSTRUCTS AND USE FOR TREATMENT OR PREVENTION OF ADRENOLEUKODYSTROPHY (ALD) AND/OR ADRENOMYELONEUROPATHY (AMN)

RELATED APPLICATIONS

This application is a continuation of International Application No. PCT/US2020/067664, filed Dec. 31, 2020, which claims priority to U.S. Provisional Application No. 62/955,667 filed on Dec. 31, 2019, each of which is incorporated by reference herein in its entirety.

SEQUENCE LISTING DISCLOSURE

The instant application contains a Sequence Listing in the file named "S218070004US01-SEQ-HJD", created on Dec. 20, 2021 and having a size of 1,063,842 bytes, which is hereby incorporated by reference in its entirety.

BACKGROUND

The present invention describes gene therapies to treat X-linked adrenoleukodystrophy (X-ALD), a progressive monogenic neurodegenerative disease, caused by mutations in the peroxisomal membrane ATP-binding cassette transporter (ABCD1) gene, which encodes for the adrenoleukodystrophy protein (ALDP) responsible for transport of CoA-activated very long-chain fatty acids (VLCFA) into the peroxisome for degradation. Human ALDP is, for example, encoded by the nucleic acid sequence identified by NCBI Reference Sequence: NM_000033 or NM_000033.4.

ALDP is an integral peroxisomal membrane protein with the ATP-binding domain located towards the cytoplasmic surface of the peroxisomal membrane and responsible for transporting VLCFA-CoA across the peroxisomal membrane into the peroxisomal matrix. ALDP deficiency results in impaired degradation of VLCFAs. As a result, X-ALD patients exhibit accumulation of high levels of saturated, very long chain fatty acids (VLCFA), e.g., saturated VLCFA with chain lengths of greater than 20 carbons (i.e., C>20 such as "C24:0" and "C26:0"), in the blood (which could be detected from either plasma or serum), and tissues of the brain, spinal cord, adrenal cortex and other tissues.

Clinical phenotypes of X-ALD include adrenomyeloneuropathy (AMN) and cerebral adrenoleukodystrophy (CCALD). Symptoms can begin in childhood or adulthood. Adult ALD patients typically develop adrenomyeloneuropathy (AMN), a debilitating neurological disorder, in their twenties (Engelen et al., *Orphanet J Rare Dis.* 2012; 7: 51). The Abcd1 knock-out mouse develops a phenotype similar to AMN, manifesting spinal cord axon degeneration as well as peripheral neuropathy due to affected dorsal root ganglia neurons (DRGs) (Pujol et al., *Hum Mol Genet.* 2002; 11:499-505).

Childhood cerebral adrenoleukodystrophy (CCALD) is a very rare, sometimes rapidly progressive, X-linked genetic neurologic disorder in boys (median age of onset age 7; range 3-15 years) that, untreated, leads to a vegetative state, and ultimately death, within a median of 5 years after diagnosis. CCALD often initially presents as Addison's disease, but the diagnosis is usually made based on "sudden" decreases in attention, thinking, concentration, and other cerebral functions with confirmatory findings of cerebral demyelination on magnetic resonance imaging (MRI). Prior to demyelination, the MRI of the patient's brain is normal, and there are no neurodevelopmental abnormalities. The clinical course may be "slow" at first but can become rapidly progressive and irreversible with the widespread loss of myelin in the brain. The terms "slow" and "sudden" are relative in that the duration of demyelination is not truly known, but the rapid decrease in cognitive and motor function can happen at any time and for unknown reasons. Indeed, the MRI changes precede symptoms, and can be floridly abnormal with widespread demyelination at a time when there are very few clinical manifestations of the disease. The incidence of X-linked ALD in the United States is about 1:21,000 male births with about 35% developing CCALD; about 35 to 40 boys are diagnosed with CCALD each year. The cause of the disease is a mutation of the ATP-binding cassette, sub-family D, member 1 (ABCD1) gene leading to a dysfunctional or absent adrenoleukodystrophy protein (ALDP) gene product. ALDP localizes to cellular peroxisomes, where it participates in the degradation of very long chain fatty acids (VLCFA) (chain lengths of >20 carbons) via beta oxidation to shorter fatty acids, which are used to maintain cellular structure and function.

Currently ALD is treated by allogeneic hematopoietic stem cell transplant (HCT) which supply cells that produce functional ALDP, and fully matched related donor human stem cell transplantation using cells producing functional ALDP can potentially ameliorate or stop the progression of demyelination. However, it takes 12 to 18 months for allogeneic HCT to stabilize the disease, and because of the progressive nature of the disease, transplantation should be done as soon as possible upon diagnosis. This is sometimes problematic because of the lead times needed to find related or unrelated matched bone marrow stem cell donors. The use of allogeneic stem cells also presents a risk of graft failure and the development of acute and chronic graft versus host disease (GvHD). These complications can lead to death and are increased in incidence when unrelated donors are utilized as a source for allogeneic hematopoietic stem cells.

Another source of ALDP replacement is the use of matched or, more typically, partially matched cord blood cell transplants. However, the use of cord blood stem cells (CBSCs) is problematic, with a risk of graft failure and prolonged time to engraftment requiring extended transfusion support. Indeed, all forms of allogeneic HCT involve a 10-15% risk of transplant related mortality, and up to a 30% risk of chronic graft versus host disease.

Adeno-associated viruses (AAVs), a defective nonpathogenic human parvovirus, are commonly used for gene delivery because of their mild immune response and lack of pathogenicity. AAV viruses can direct long-term transgene expression, but generally are not permanently integrated into the host genome. Given such capabilities, AAVs provide a viable option for safe and effective gene therapies. While transduction of central nervous system cells in vitro and in vivo using recombinant adeno-associated virus serotype 9 (rAAV9) vectors for delivery of the human ABCD1 gene was previously reported, there is an unmet need in the art for safer and more efficient adrenoleukodystrophy therapies. Given that different AAV serotypes display different cellular tropisms, it important to select an optimal serotype(s) for establishing a gene transfer system. The present invention provides solutions to these and other problems by providing improved adeno-associated viral vectors and delivery systems that are safe and effective, i.e., which may be used to deliver non-toxic levels of ABCD1 in patients suffering from X-ALD or AMN.

BRIEF SUMMARY OF THE INVENTION

It is a specific object of the invention to provide safe and effective methods and materials for treating or preventing ALD or AMN involving the administration of novel and improved AAV DNA constructs.

The present invention provides improved adeno-associated virus (AAV) constructs. The present invention also provides for the method for producing the improved recombinant AAV (rAAV) vectors through co-transfection of a plasmid containing the rAAV vector genome which encodes the ATP-binding cassette, sub-family D, member 1 (ABCD1) gene ("rAAV Genome Vector") and a second plasmid encoding the AAV Rep and Cap protein ("Rep/Cap plasmid"), and one or more virus helper plasmids. The present invention also provides cells and compositions containing these AAV constructs which may be used in the treatment and/or prevention of adrenoleukodystrophy and/or adrenomyeloneuropathy in subjects in need thereof.

The present invention further provides methods for making such improved AAV constructs which encode the ABCD1 gene expressing ALD proteins ("ALDPs", also referred to herein as "ABCD1" protein). Also, the invention provides methods of using the subject improved AAV constructs which express the ALD proteins and cells and compositions containing for the treatment and/or prevention of adrenoleukodystrophy and/or adrenomyeloneuropathy in subjects in need thereof, e.g., methods wherein such improved AAV constructs are administered, e.g., by intrathecal, intracerebroventricular (ICV), intrathecal-lumbar (IT-L), intravascular, intramuscular, or intracisternal administration.

In some embodiments, the present invention contemplates in part, an rAAV Genome Vector comprising: (a) a 5' Inverted Terminal Repeat (5'ITR); (b) a promoter operably linked to a polynucleotide encoding a human ABCD1 gene; (c) a modified woodchuck post-transcriptional regulatory element, wherein the X-protein, is inactivated (WPRE x-inact); (d) at least one terminator; (e) at least one polyA signal and (f) a 3' Inverted Terminal Repeat (3' ITR).

In some embodiments, the present invention contemplates in part, an rAAV Genome Vector comprising: (a) a 5' Inverted Terminal Repeat (5'ITR); (b) an enhancer operably linked to (c) a promoter further comprising an intron at its 3' end and operably linked to (d) a polynucleotide encoding a human ABCD1 gene; (e) a modified woodchuck post-transcriptional regulatory element, wherein the X-protein, is inactivated (WPRE x-inact); (f) at least one terminator; (g) at least one polyA signal and (h) a 3' Inverted Terminal Repeat (3' ITR).

In some embodiments, the present invention contemplates in part, an rAAV Genome Vector comprising: (a) a 5' Inverted Terminal Repeat (5'ITR); (b) a promoter operably linked to a polynucleotide encoding a human ABCD1 gene further comprising an enhancer at its 5' end or an intron at its 3' end; (c) a modified woodchuck post-transcriptional regulatory element, wherein the X-protein, is inactivated (WPRE x-inact); (d) at least one terminator; (e) at least one polyA signal and (f) a 3' Inverted Terminal Repeat (3' ITR).

In some embodiments, the present invention contemplates in part, an rAAV Genome Vector comprising: (a) a 5' Inverted Terminal Repeat (5'ITR); (b) a promoter operably linked to a polynucleotide encoding a human ABCD1 gene; (c) at least one terminator; (d) at least one polyA signal and (e) a 3' Inverted Terminal Repeat (3' ITR).

In some embodiments, the present invention contemplates in part, an rAAV Genome Vector comprising: (a) a 5' Inverted Terminal Repeat (5'ITR); (b) an enhancer operably linked to (c) a promoter further comprising an intron at its 3' end; (d) operably linked to a polynucleotide encoding a human ABCD1 gene; (e) at least one terminator; (f) at least one polyA signal and (g) a 3' Inverted Terminal Repeat (3' ITR).

In some embodiments, the present invention contemplates in part, an rAAV Genome Vector comprising: (a) a 5' Inverted Terminal Repeat (5'ITR); (b) a promoter operably linked to a polynucleotide encoding a human ABCD1 gene further comprising an enhancer at its 5'end or an intron at its 3'end; (c) at least one terminator; (d) at least one polyA signal and (e) a 3' Inverted Terminal Repeat (3' ITR).

In some embodiments, the present invention contemplates in part, an rAAV Genome Vector comprising: (a) a 5' Inverted Terminal Repeat (5'ITR); (b) a promoter operably linked to a polynucleotide encoding a human ABCD1 gene further comprising at its 5' end, a Kozak Consensus Sequence ('CCACC' or 'GCCACC', or any sequence representing an approach to the consensus sequence for optimal protein translation initiation: 'GCCRCCATGG'); (c) at least one terminator; (d) at least one polyA signal and (e) a 3' Inverted Terminal Repeat (3' ITR).

In some embodiments, the present invention contemplates in part, an rAAV Genome Vector comprising: (a) a 5' Inverted Terminal Repeat (5'ITR); (b) an enhancer operably linked to (c) a promoter further comprising an intron at its 3' end and operably linked to (d) a polynucleotide encoding a human ABCD1 gene further comprising at its 5' end, a Kozak Consensus Sequence ('CCACC' or 'GCCACC', or any sequence representing an approach to the consensus sequence for optimal protein translation initiation: 'GCCRCCATGG'); (e) at least one terminator; (f) at least one polyA signal and (g) a 3' Inverted Terminal Repeat (3' ITR).

In some embodiments, the present invention contemplates in part, an rAAV Genome Vector comprising: (a) a 5' Inverted Terminal Repeat (5'ITR); (b) a promoter operably linked to a polynucleotide encoding a human ABCD1 gene further comprising at its 5' end, a Kozak Consensus Sequence ('CCACC' or 'GCCACC', or any sequence representing an approach to the consensus sequence for optimal protein translation initiation: 'GCCRCCATGG'); (c) optionally an enhancer at the 5' end of the Kozak sequence or an intron at the 3' end of the promoter; (d) at least one terminator; (e) at least one polyA signal and (f) a 3' Inverted Terminal Repeat (3' ITR).

In some embodiments, the present invention contemplates in part, an rAAV Genome Vector comprising: (a) a 5' Inverted Terminal Repeat (5'ITR); (b) a promoter operably linked to a Kozak Consensus Sequence ('CCACC' or 'GCCACC', or any sequence representing an approach to the consensus sequence for optimal protein translation initiation: 'GCCRCCATGG') upstream of a polynucleotide encoding a human ABCD1 gene containing 3, 6, or 9 nucleotide changes within the ABCD1 coding sequence; (c) at least one terminator; (d) at least one polyA signal and (e) a 3' Inverted Terminal Repeat (3' ITR).

In some embodiments, the present invention contemplates in part, an rAAV Genome Vector comprising: (a) a 5' Inverted Terminal Repeat (5'ITR); (b) an enhancer operably linked to (c) a promoter comprising an intron at its 3' end (d) a Kozak Consensus Sequence ('CCACC' or 'GCCACC', or any sequence representing an approach to the consensus sequence for optimal protein translation initiation: 'GCCRCCATGG') upstream of a polynucleotide encoding a human ABCD1 gene containing 3, 6, or 9 nucleotide changes within the ABCD1 coding sequence; (e) at least one terminator; (f) at least one polyA signal and (g) a 3' Inverted Terminal Repeat (3' ITR).

In some embodiments, the present invention contemplates in part, an rAAV Genome Vector comprising: (a) a 5' Inverted Terminal Repeat (5'ITR); (b) a promoter operably linked to a Kozak Consensus Sequence ('CCACC' or 'GCCACC', or any sequence representing an approach to the consensus sequence for optimal protein translation initiation: 'GCCRCC<u>ATG</u>G') upstream of a polynucleotide encoding a human ABCD1 gene containing 3, 6, or 9 nucleotide changes within the ABCD1 coding sequence; (c) optionally an enhancer at the 5' end of the Kozak sequence or an intron at the 3' end of the promoter (d) at least one terminator; (e) at least one polyA signal and (f) a 3' Inverted Terminal Repeat (3' ITR).

In any of the embodiments, the at least one terminator may be comprised in the ABCD1 gene-encoding polynucleotide.

In some embodiments the rAAV genome comprises an enhancer, a promoter, a β-actin exon, an intron, and/or a β-globin exon, optionally in the direction from the 5'end to the 3'end.

In some of the embodiments the enhancer is a CMV enhancer.

In some of the embodiments the promoter is a Chicken Beta Actin Promotor.

In some of the embodiments the β-actin exon is derived from one of the alternate transcripts of chicken beta actin and the chimeric intron consists of the donor from the chicken beta actin first intron and the acceptor from the rabbit beta-globin second[1] intron.

In some of the embodiments the intron is a chimeric intron.

[1] When we refer to a "first", "second" or "third" exon here this refers to the "first", "second" or "third" exon in the transcript from the 5' end.

In some of the embodiments, the β-globin exon is a rabbit β-globin exon, such as a rabbit β-globin third exon.

In any of the embodiments, the polyA signal may comprise SV40 polyA signal, bGH polyA signal, or a combination thereof. A polyA signal may also be referred to herein as "pA".

In other embodiments the present invention contemplates in part, an AAV Rep/Cap plasmid comprising: (a) a promoter (b) a replication gene; (c) a capsid gene.

In some embodiments the Rep/Cap plasmid comprises one or more of the p5, p19, or p40 promoters.

In some embodiments the replication gene is selected from the replication gene or a variant thereof of AAV serotypes AAV1, AAV2, AAV3, AAV4, AAV5, AAV6, AAV7, AAV8, AAV9, or AAVrh.10 encoding for Rep 78, Rep 68, Rep 52, or Rep 40 proteins.

In some embodiments, the replication gene is or is derived from the replication gene of AAV2, AAV9, or AAVrh.10.

In some embodiments, when the replication gene (Rep gene) is derived from that of AAV2, two replication gene products, REP78 and REP68 may be transcribed by the p5 promoter, two replication gene products, and REP52 and REP40 may be transcribed by the p19 promoter. In some embodiments, the capsid gene is selected from the capsid gene or a variant thereof of AAV1, AAV2, AAV3, AAV4, AAV5, AAV6, AAV7, AAV8, AAV9, or AAVrh.10 encoding for VP1, VP2, and/or VP3 proteins.

In some embodiments, the capsid gene is or is derived from the capsid gene of AAV2, AAV9 or AAVrh.10 (also referred to herein as AAVrh10).

In some embodiments, when the capsid gene (Cap gene) is derived from that of AAV9, three replication gene products VP1, VP2, and VP3 of AAV9 may be transcribed by (i.e., transcribed under the control of) the p40 promoter.

In some embodiments, when the capsid gene (Cap gene) is derived from that of AAV2, three replication gene products VP1, VP2, and VP3 of AAV2 may be produced.

In some embodiments, when the capsid gene (Cap gene) is derived from that of AAVrh.10, three replication gene products VP1, VP2, and VP3 of AAVrh.10 may be produced.

In some embodiments, the Rep/Cap plasmid may be entirely derived from AAV1, AAV2, AAV3, AAV4, AAV5, AAV6, AAV7, AAV8, AAV9, or AAVrh.10, while in some embodiments, the Rep/Cap plasmid may be of a hybrid serotype, such as AAV2/9, which comprises one or more elements/genes from AAV2 and one or more elements/genes from AAV9. In certain embodiments, when the Rep/Cap plasmid is of AAV2/9 serotype, the Rep gene may be of AAV2 and the Cap gene may be of AAV9.

In some embodiments the 5' and 3' inverted Terminal Repeats (ITRS) is naturally occurring from serotypes AAV1, AAV2, AAV3, AAV4, AAV5, AAV6, AAV7, AAV8, AAV9, or AAVrh.10.

In some embodiments the 5' and 3' inverted Terminal Repeat (ITRS) is AAV2.

In some embodiments the 5' and 3' inverted Terminal Repeat (ITRS) are shortened by 15 nucleotides ('TTGGC-CACTCCCTCT') at the 5' end and the last 15 nucleotides ('AGAGGGAGTGGCCAA') at the 3' end relative to the natural AAV2 ITRs. This (the set of two removed 15 nucleotide sequences) includes almost all the A region.

In other embodiments, the present invention contemplates in part, a helper virus or a virus helper plasmid to aid in rAAV production. In some embodiments, the helper virus is adenovirus, herpes simplex virus, or papillomavirus. In some embodiments, the virus helper plasmid comprises one or more genes of adenovirus, herpes simplex virus, or papillomavirus. In some embodiments the helper virus or the virus helper plasmid is derived from or comprises one or more genes of a wildtype (WT) or variant adenovirus such as Adenovirus 5 (Ad5) (e.g., Accession No. AC_000008.1 or SEQ ID NO: 2000) or Adenovirus 2 (Ad2) (e.g., Accession No. J01917.1 or SEQ ID NO: 3000), herpes simplex virus (HSV) such as Human HSV Type I (e.g., Accession No. NC_001806), papillomavirus, or a vaccinia virus (e.g., Accession No. NC_006998).

In some embodiments, the helper virus or the virus helper plasmid comprises the E1, E2A, E4 and/or VA RNA region sequences from Adenovirus.

In some embodiments, such helper virus or virus helper plasmid(s) provide(s) one or more genes or gene products (or elements or factors) that facilitate rAAV vector packaging, production, and/or function.

In some embodiments, when the helper virus or the virus helper plasmid is derived from Ad5 (for example, the plasmid referred to herein as "pALD-X80"), the helper virus or plasmid may contain Ad5 Region VA-RNA, Ad5 Region E2, and/or Ad5 Region E4. In certain embodiments, the Ad5 Region VA-RNA may contain an VA-RNA region (VA RNA I) and/or an VA-RNA region (VA RNA II). In certain embodiments, the Ad5 Region E2 may encode Hexon (C-terminal fragment), 23K endoprotease, E2A/DBP, Hexon Assembly (100K), Hexon Assembly (33K), Hexon Assembly (22K), and/or Hexon-associated precursor. In certain embodiments, the Ad5 Region E4 may encode Fiber, E4 ORF1, E4 ORF2, E4 ORF3, E4 ORF4, E4 ORF6, and/or E4 ORF6/7.

In some embodiments, when the helper virus or plasmid is derived from Ad2 (for example, the plasmid referred to herein as "pHELP_KanV4"), the helper virus or plasmid may contain an Ad2 Region VA-RNA, Ad2 Region E2, and/or Ad2 Region E4. In certain embodiments, the Ad2 Region VA-RNA may contain VA-RNA region (VA RNA I) and/or VA-RNA region (VA RNA II). In certain embodiments, the Ad2 Region E2 may not encode Hexon and may encode 23K endoprotease (C-terminal fragment), E2A/DBP, Hexon Assembly (100K), Hexon Assembly (33K), Hexon Assembly (22K), and/or Hexon-associated precursor. In certain embodiments, the Ad2 Region E4 may not encode Fiber and may encode E4 ORF1, E4 ORF2, E4 ORF3, E4 ORF4, E4 ORF6, and/or E4 ORF6/7.

In some embodiments, the present invention contemplates in part, an isolated polynucleotide comprising a recombinant adeno-associated virus (rAAV) vector genome which may be packaged in viral capsids to form a rAAV virion, wherein said rAAV vector genome comprises or consists of: (a) a 5' AAV inverted terminal repeat (ITR); (b) an expression cassette, wherein the expression cassette comprises at least (i) a promoter active in target cells, operably linked to (ii) a polynucleotide encoding an ATP-binding cassette, sub-family D, member 1 (ABCD1) polypeptide, (iii) one or more terminators and (iv) one or more poly A signal downstream of said ABCD1-encoding polynucleotide; and (c) a 3' ITR. The rAAV vector genome may not comprise a woodchuck post-transcriptional regulatory element (WPRE) or may comprises a modified WPRE comprising at least one mutation which results in the X protein not being expressed or being expressed in an inactivated form (WPREx-inact).

In some embodiments, the present invention contemplates in part, an rAAV vector which may be generated using any of the aforementioned AAV genome vector, along with any of the aforementioned Rep/Cap plasmids and any of the aforementioned virus helper plasmids.

In some embodiments, the present invention contemplates in part, an rAAV vector comprising (I) any of the aforementioned AAV capsids and (II) any of the aforementioned AAV genomes.

In some embodiments, the present invention contemplates in part, a composition comprising (A) any of the rAAV genome vector and optionally one or more of: (B) a polynucleotide comprising any of the aforementioned AAV cap gene; (C) a polynucleotide comprising any of the aforementioned AAV rep gene; (D) a polynucleotide comprising any of the aforementioned adenovirus helper genes; and/or (E) a pharmaceutically acceptable carrier or excipient. In some instances, such compositions may be used for producing any of the aforementioned rAAV vectors.

In some embodiments, the present invention contemplates in part, a composition comprising (I) any of the aforementioned rAAV vector and (II) a pharmaceutically acceptable carrier. In some instances, such a composition may be used in any of the methods of treating and preventing disease conditions disclosed herein, e.g., adrenoleukodystrophy (ALD) or adrenomyeloneuropathy (AMN).

In some embodiments, the present invention contemplates in part, the method of making any of the aforementioned AAV constructs.

In some embodiments, the present invention contemplates in part, the method of using or administering any of the aforementioned AAV constructs for the treatment of adrenoleukodystrophy (ALD) or adrenomyeloneuropathy (AMN) in a subject in need thereof.

In some embodiments, the present invention contemplates in part, the method of using or administering any of the aforementioned AAV constructs in combination with a pharmaceutically acceptable carrier.

BRIEF DESCRIPTION OF THE DRAWINGS

FIG. 1A-B contain the results of in vivo experiments comparing ABCD1 expression in spinal cord samples in ABCD1 knock-out (KO) mice administered different AAV9-CBA-ABCD1 virions (referred to as "AAV9" due to the use of AAV9 capsid) respectively containing a WPRE, a modified WPRE (containing a mutation which results in the X protein being inactivated) or AAV9-CBA-ABCD1 virions which lack a WPRE wherein ABCD1 expression was detected in spinal cord samples using Western blot methods.

FIG. 3A-3C compares the dose response of ABCD1 expression in spinal cord samples of ABCD1 knock-out mice which were administered different dosages ($3 \times 10^{11}$ or $1 \times 10^{11}$ genome copies/mouse) of AAV9-CBA-ABCD1 virions respectively containing a WPRE (identified as "original"), containing a modified WPRE (comprising a mutation which results in the X protein being inactivated, identified as "X-inactivated") or AAV9-CBA-ABCD1 virions which lack a WPRE; wherein ABCD1 expression was again detected in spinal cord samples obtained from the ABCD1 knock-out mice which were administered the different doses using Western blot methods. ABCD1 expression was lower in virions lacking WPRE.

FIG. 4A-4B compare VLCFA levels in mixed glial cultures transduced with different AAV9-ABCD1 virions containing a WPRE ("original") or containing a modified WPRE (comprising a mutation which results in the X protein being inactivated, "x-inact") wherein VLCFA levels are detected 4 days post transduction from harvested cells for VLCFA analysis. As shown VLCFA levels are lowered to about the same extent in the mixed glial cell cultures which were transduced with different AAV9.ABCD1 virions. All AAV vectors lowered VLCFA in a dose-dependent manner.

FIG. 9 compares the packageability of pSBT101 and pOB1005 into AAV based on titer (gc/ml), productivity (gc/cell) and yield (gc's).

FIG. 10B provides a table summarizing the SEQ ID NOs assigned to: the sequence of different elements contained in the 5' ITR-3' ITR of respective rAAV genome vectors (plasmids that may be used for producing the indicated rAAV viral particles); the 5' ITR-3' ITR sequence contained in the respective rAAV genome vectors; the rAAV vector genome sequence contained in the respective rAAV genome vectors (i.e., the sequence packaged into the indicated rAAV viral particles); and the full plasmid sequence of respective rAAV genome vectors. For example, the rAAV genome vector for AAV-CBA-hABCD1-Xinact, has the nucleic acid sequence of SEQ ID NO: 10000, which comprises the 5'ITR-3'ITR sequence of SEQ ID NO: 10050, which comprises different elements such as the 5'ITR (SEQ ID NO: 10001), CMV enhancer (SEQ ID NO: 10005), beta actin exon (SEQ ID NO: 10008), and so forth. "Total poly A signal" refers to the region spanning from the start of SV40 poly A signal to the end of bGH poly A signal. The vector genome of the rAAV virus AAV-CBA-hABCD1-Xinacthas the nucleic acid sequence of SEQ ID NO: 10060. The SEQ ID NO assignments for vectors AAV-CBA-hABCD1-Xinact and AAV-CBA-hABCD1 [no WPRE] are further visually depicted in FIG. 11A-11B.

FIGS. 13A-13E provide exemplary ABCD1 protein expression levels obtained in Example 8 using different rAAVs according to the present disclosure. FIGS. 13A-13D provides ABCD1 protein levels plotted against the MOI with dose-expression curves fitted as described in each figure, estimated relative potential (relative to pOB1008 in FIGS. 13A-13C and relative to SBT101 in FIG. 13D), standard error, 95% confidence interval, and EC50 values for each AAV vector. Plasmids used to produce the test rAAVs are indicated in the bottom box. FIG. 13E shows exemplary western blot wells and relative intensity data.

FIG. 14 compares exemplary reduction of VLCFA by rAAV vectors pOB1010, pOB1015, and pOB1017 observed in Example 9. Lyso-PC C26/C22 ratios plotted against the MOI with dose-expression curves fitted as described in each figure, estimated relative potential (relative to OB1010), standard error, 95% confidence interval, and EC50 values for each AAV vector are provided. Plasmids used to produce the test rAAVs are indicated in the bottom box.

FIG. 15A shows that low, mid, and high doses ($3.3 \times 10^4$, $1.0 \times 10^5$, and $5 \times 10^5$ virus genomes per cell, respectively) of OB1010 provided rAAV dose-dependent reduction in the C26:0/C22:0 ratio and in the C26:0 amount, regardless of the vendor of rAAV production (different purification methods). FIG. 15B shows that VLCFA reduction effects, reduction in C26:0/C22:0 ratio and in C24:0/C22:0 ratio, are dependent on the ABCD1 protein expression levels. FIG. 15C further shows that various VLCFA reduction effects, reduction in the amounts of C26:0 and C24:0 and the C26:0/C22:0 and C24:0/C22:0 ratios, are dependent on the ABCD1 protein expression levels. FIG. 15C also shows that ABCD1 protein levels, on the other hand, do not affect the C22:0 amounts and increase the C16:0 amount.

FIG. 17 provides exemplary results from rAAV packageability comparison in Example 12. Viral titers as determined by the indicated methods (ddPCR and qPCR) obtained by the same production scale using pOB1010, pSBT101, and pOB1008 plasmids are provided.

DETAILED DESCRIPTION OF THE INVENTION

Definitions

Figure 2A:
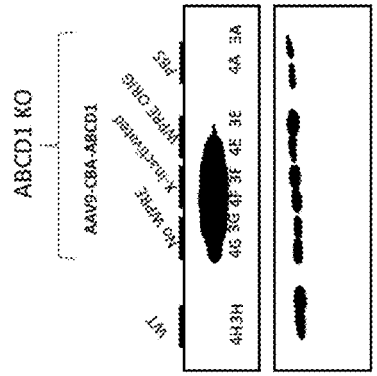
FIG. 2A-C contain Western blot data of additional in vivo experiments wherein ABCD1 knock-out mice were administered different dosages of AAV9-CBA-ABCD1 virions respectively containing a WPRE (identified as "original"), a modified WPRE (containing a mutation which results in the X protein being inactivated, identified as "X-inactivated") or AAV9-CBA-ABCD1 virions which lack a WPRE wherein ABCD1 expression was detected in spinal cord samples obtained from treated ABCD1 knock-out mice using Western blot methods.

Unless otherwise defined, all technical and scientific terms used herein have the same meaning as commonly understood by one of ordinary skill in the art to which this invention belongs. In case of conflict, the present application, including definitions will control.

As used herein, the term "adenovirus-associated virus vector", "adenovirus-associated viral vector", or "AAV vector" encompasses recombinant viral particles comprising (i) at least one capsid protein derived from an AAV and (ii) a recombinant vector genome encoding a gene of interest. In an AAV vector, the recombinant genome is typically packaged or enclosed in the capsid(s) to form a recombinant AAV virion. An "AAV vector" may be also referred to herein as "AAV particle", "recombinant AAV", "rAAV", "recombinant AAV vector", "rAAV vector", "recombinant AAV particle", or "rAAV particle". The recombinant vector genome of an rAAV vector may be referred to herein as "AAV vector genome", "recombinant AAV genome", "rAAV genome", "recombinant AAV vector genome", "rAAV vector genome", or simply "vector genome" or "recombinant vector genome".

As used herein, an "expression cassette" refers to a nucleic acid molecule which comprises the coding sequences for human ABCD1 protein, promoter, and may include other regulatory sequences therefor, which cassette may be packaged into the capsid of a viral vector (e.g., a viral particle). Typically, such an expression cassette for generating an AAV vector contains the sequences described herein flanked by packaging signals or ITRs of the viral genome and other expression control sequences such as those described herein. For example, for an AAV viral vector, the packaging signals are the 5' inverted terminal repeat (ITR) and the 3' ITR. When packaged into the AAV capsid, the ITRs in conjunction with the expression cassette may be referred to herein as the "recombinant AAV (rAAV) genome" or "vector genome".

As used herein, the term "regulatory sequences", "transcriptional control sequence" or "expression control sequence" refers to DNA sequences, such as initiator sequences, enhancer sequences, and promoter sequences, which induce, repress, or otherwise control the transcription of protein encoding nucleic acid sequences to which they are operably linked.

As used herein, the term "operably linked" or "operatively associated" refers to both expression control sequences that are contiguous with the nucleic acid sequence encoding the human ABCD1 and/or expression control sequences that act in trans or at a distance to control the transcription and expression thereof.

In one aspect, a vector comprising any of the expression cassettes described herein is provided. As described herein, such vectors can be plasmids of variety of origins and are useful in certain embodiments for the generation of recombinant replication defective viruses as described further herein.

A "vector" as used herein is a nucleic acid molecule into which an exogenous or heterologous or engineered nucleic acid transgene may be inserted which can then be introduced into an appropriate host cell. Vectors preferably have one or more origin of replication, and one or more site into which the recombinant DNA can be inserted. Vectors often have means by which cells with vectors can be selected from those without, e.g., they encode drug resistance genes. Common vectors include plasmids, viral genomes, and (primarily in yeast and bacteria) "artificial chromosomes." Certain plasmids are described herein.

In one embodiment, the vector is a non-viral plasmid that comprises an expression cassette described thereof, e.g., "naked DNA", "naked plasmid DNA", RNA, and mRNA; coupled with various compositions and nano particles, including, e.g., micelles, liposomes, cationic lipid-nucleic acid compositions, poly-glycan compositions and other polymers, lipid and/or cholesterol-based-nucleic acid conjugates, and other constructs such as are described herein. See, e.g., X. Su et al, *Mol. Pharmaceutics*, 2011, 8 (3), pp 774-787; web publication: Mar. 21, 2011; WO2013/182683, WO 2010/053572 and WO 2012/170930, all of which are incorporated herein by reference. Such non-viral human ABCD1 vector may be administered by the routes described herein. As used herein, the term "subject" as used herein means a mammalian animal, including a human, a veterinary or farm animal, a domestic animal or pet, and animals normally used for clinical research. In a preferred embodiment, the subject of these methods and compositions is a human. Still other suitable subjects include, without limitation, murine, rat, canine, feline, porcine, bovine, ovine, non-human primate and others. As used herein, the term "subject" is used interchangeably with "patient".

The treated subject may comprise an individual diagnosed with adrenoleukodystrophy and/or adrenomyeloneuropathy or may exhibit symptoms associated with the onset of ALD or AMN such as the accumulation of high levels of saturated, very long chain fatty acids (VLCFA) in plasma or may be at risk of developing ALD or AMN because of family history or the individual may have been determined during genetic testing to comprise one or more mutations in the ABCD1 gene, e.g., a mutation which have been found to correlate to the development of ALD or AMN.

As mentioned the ABCD1 coding sequence in the AAV construction optionally may be codon optimized such that an increased number or percentage of the codons comprise human preferred codons. The term "percent (%) identity", "sequence identity", "percent sequence identity", or "percent identical" in the context of nucleic acid sequences refers to the residues in the two sequences which are the same when aligned for correspondence. The length of sequence identity comparison may be over the full-length of the genome, the full-length of a gene coding sequence, or a fragment of at least about 500 to 5000 nucleotides, is desired. However, identity among smaller fragments, e.g. of at least about nine nucleotides, usually at least about 20 to 24 nucleotides, at least about 28 to 32 nucleotides, at least about 36 or more nucleotides, may also be desired.

Percent identity may be readily determined for amino acid sequences over the full-length of a protein, polypeptide, about 32 amino acids, about 330 amino acids, or a peptide fragment thereof or the corresponding nucleic acid sequence coding sequences. A suitable amino acid fragment may be at least about 8 amino acids in length and may be up to about 700 amino acids. Generally, when referring to "identity", "homology", or "similarity" between two different sequences, "identity", "homology" or "similarity" is determined in reference to "aligned" sequences. "Aligned" sequences or "alignments" refer to multiple nucleic acid sequences or protein (amino acids) sequences, often containing corrections for missing or additional bases or amino acids as compared to a reference sequence.

Identity may be determined by preparing an alignment of the sequences and through the use of a variety of algorithms and/or computer programs known in the art or commercially available [e.g., BLAST, ExPASy; Clustal; FASTA; using, e.g., Needleman-Wunsch algorithm, Smith-Waterman algorithm]. Alignments are performed using any of a variety of publicly or commercially available Multiple Sequence Alignment Programs. Sequence alignment programs are available for amino acid sequences, e.g., the "Clustal Omega", "Clustal X", "MAP", "PIMA", "MSA", "BloCK-MAKER", "MEME", and "Match-Box" programs. Generally, any of these programs are used at default settings, although one of skill in the art can alter these settings as needed. Alternatively, one of skill in the art can utilize another algorithm or computer program which provides at least the level of identity or alignment as that provided by the referenced algorithms and programs. See, e.g., J. D. Thomson et al, "A comprehensive comparison of multiple sequence alignments", *Nucl. Acids. Res.,* 27(13):2682-2690 (1999).

Multiple sequence alignment programs are also available for nucleic acid sequences. Examples of such programs include, "Clustal Omega", "Clustal W", "CAP Sequence Assembly", "BLAST", "MAP", and "MEME", which are accessible through Web Servers on the internet. Other sources for such programs are known to those of skill in the art. Alternatively, SnapGene can be used. There are also a number of algorithms known in the art that can be used to measure nucleotide sequence identity, including those contained in the programs described above. As another example, polynucleotide sequences can be compared using Fasta™, a program in GCG Version 6.1. Fasta™ provides alignments and percent sequence identity of the regions of the best overlap between the query and search sequences. For instance, percent sequence identity between nucleic acid sequences can be determined using Fasta™ with its default parameters (a word size of 6 and the NOPAM factor for the scoring matrix) as provided in GCG Version 6.1, herein incorporated by reference.

The term "exogenous" as used to describe a nucleic acid sequence or protein means that the nucleic acid or protein does not naturally occur in the position in which it exists in a chromosome, or host cell. An exogenous nucleic acid sequence also refers to a sequence derived from and inserted into the same host cell or subject, but which is present in a non-natural state, e.g. a different copy number, or under the control of different regulatory elements.

The term "heterologous" as used to describe a nucleic acid sequence or protein means that the nucleic acid or protein was derived from a different organism or a different species of the same organism than the host cell or subject in which it is expressed. The term "heterologous" when used with reference to a protein or a nucleic acid in a plasmid, expression cassette, or vector, indicates that the protein or the nucleic acid is present with another sequence or subsequence with which the protein or nucleic acid in question is not found in the same relationship to each other in nature.

The term "isolated" means that the material is removed from its original environment (e.g., the natural environment if it is naturally occurring). For example, a naturally-occurring polynucleotide or polypeptide present in a living animal is not isolated, but the same polynucleotide or polypeptide, separated from some or all of the coexisting materials in the natural system, is isolated, even if subsequently reintroduced into the natural system. Such polynucleotides could be part of a vector and/or such polynucleotides or polypeptides could be part of a composition, and still be isolated in that such vector or composition is not part of its natural environment.

The term "terminator" as used herein encompasses nucleic acid sequences that terminate translation. For example, a terminator may be the RNA sequence "UAG", "UGA", or "UAA", corresponding to the DNA sequences "TAG", "TGA", or "TAA", respectively.

As used herein, the terms "alternative open reading frame", "alternative reading frame", or "alternative frame" each refer to a potential protein-coding sequence contained within the coding sequence of a gene of interest, e.g., ABCD1. An alternative open reading frame typically begins with a start codon (ATG) in the sense (or antisense) orientation that is in a different reading frame than the ABCD1 gene, e.g., in the +1 or +2 frame. Alternative open reading frames in the same orientation as the ABCD1 may result in transcription of alternative products that are potentially immunogenic and/or may result in reduced translation of the ABCD1 gene. Alternative open reading frames may be eliminated by introducing one or more mutations that remove the ATG sequence present in the alternative frame, which mutations are preferably silent with respect to the ABCD1 gene coding sequence (or alternatively may introduce a mutation in the ABCD1 sequence, such as a conservative mutation). Alternatively or in addition, a stop codon (TAA, TGA, or TAG) may be introduced in an alternative reading frames, e.g., downstream within a few codons of an ATG present in an alternative open reading frame, such that the encoded polypeptide is truncated, preferably to only one or a few amino acids. Moreover, the mutations introduced with respect to the ABCD1 coding sequence preferably avoid introducing rare codons that may result in slowed or reduced translation.

In exemplary embodiments, the ABCD1 coding sequence comprises one or more codon-optimized regions. Codon-optimized coding regions can be designed by various different methods. This optimization may be performed using methods which are available on-line (e.g., GeneArt), published methods, or a company which provides codon optimizing services, e.g., ATUM (Newark, CA). One codon optimizing method is described, e.g., in US International Patent Publication No. WO 2015/012924, which is incorporated by reference herein in its entirety. See also, e.g., US Patent Publication No. 2014/0032186 and US Patent Publication No. 2006/0136184. Suitably, the entire length of the open reading frame (ORF) for the product is modified. However, in some embodiments, only a fragment of the ORF may be altered. By using one of these methods, one can apply the frequencies to any given polypeptide sequence and produce a nucleic acid fragment of a codon-optimized coding region which encodes the polypeptide.

A number of de novo and recombinant options are available for performing the actual changes to the codons or for synthesizing codon-optimized coding regions. Such modifications or synthesis can be performed using standard and routine molecular biological manipulations well known to those of ordinary skill in the art. In one approach, a series of complementary oligonucleotide pairs of 80-90 nucleotides each in length and spanning the length of the desired sequence are synthesized by standard methods. These oligonucleotide pairs are synthesized such that upon annealing, they form double stranded fragments of 80-90 base pairs, containing cohesive ends, e.g., each oligonucleotide in the pair is synthesized to extend 3, 4, 5, 6, 7, 8, 9, 10, or more bases beyond the region that is complementary to the other oligonucleotide in the pair. The single-stranded ends of each pair of oligonucleotides are designed to anneal with the single-stranded end of another pair of oligonucleotides. The oligonucleotide pairs are allowed to anneal, and approximately five to six of these double-stranded fragments are then allowed to anneal together via the cohesive single stranded ends, and then they ligated together and cloned into a standard bacterial cloning vector, for example, a TOPO® vector available from Invitrogen Corporation, Carlsbad, Calif. The construct is then sequenced by standard methods. Several of these constructs consisting of 5 to 6 fragments of 80 to 90 base pair fragments ligated together, i.e., fragments of about 500 base pairs, are prepared, such that the entire desired sequence is represented in a series of plasmid constructs. The inserts of these plasmids are then cut with appropriate restriction enzymes and ligated together to form the final construct. The final construct is then cloned into a standard bacterial cloning vector, and sequenced. Such methods may also be used to construct coding sequences in which one or more alternative open reading frames have been eliminated. Additional methods would be immediately apparent to the skilled artisan. In addition, gene synthesis is readily available commercially.

By "engineered" is meant that the nucleic acid sequences encoding the ABCD1 protein described herein are assembled and placed into any suitable genetic element, e.g., naked DNA, phage, transposon, cosmid, episome, etc., which transfers the ABCD1 sequences carried thereon to a host cell, e.g., for generating non-viral delivery systems (e.g., RNA-based systems, naked DNA, or the like) or for generating viral vectors in a packaging host cell and/or for delivery to a host cells in a subject. In one embodiment, the genetic element is a plasmid. The methods used to make such engineered constructs are known to those with skill in nucleic acid manipulation and include genetic engineering, recombinant engineering, and synthetic techniques. See, e.g., Green and Sambrook, Molecular Cloning: A Laboratory Manual, Cold Spring Harbor Press, Cold Spring Harbor, NY (2012).

As used herein, the term "host cell" may refer to the packaging cell line in which a recombinant AAV is produced from a production plasmid. In the alternative, the term "host cell" may refer to any target cell in which expression of the coding sequence is desired. Thus, a "host cell," refers to a prokaryotic or eukaryotic cell that contains exogenous or heterologous DNA that has been introduced into the cell by any means, e.g., electroporation, calcium phosphate precipitation, microinjection, transformation, viral infection, transfection, liposome delivery, membrane fusion techniques, high velocity DNA-coated pellets, viral infection and protoplast fusion. In certain embodiments herein, the term "host cell" refers to the cells employed to generate and package the viral vector or recombinant virus. In other embodiments herein, the term "host cell" refers to cultures of CNS cells of various mammalian species for in vitro assessment of the compositions described herein. Still in other embodiments, the term "host cell" is intended to reference the cells of the nervous system of the subject being treated in vivo for ALD or AMN disease.

Such host cells include epithelial cells of the CNS including ependyma, the epithelial lining of the brain ventricular system. Other host cells include neurons, astrocytes, oligodendrocytes, dorsal root ganglia and microglia.

As used herein, the term "treatment" or "treating" is defined encompassing administering to a subject one or more DNA constructs or compositions described herein for the purposes of amelioration of one or more symptoms of ALD or AMN. "Treatment" can thus include one or more of reducing onset or progression of ALD or AMN, preventing disease, reducing the severity of the disease symptoms, or retarding their progression, including the accumulation of high levels of saturated, very long chain fatty acids (VLCFA) in plasma and tissues of the brain, spinal cord, and adrenal cortex; adrenomyeloneuropathy (AMN); peripheral neuropathy due to affected dorsal root ganglia neurons (DRGs); onset of Addison's disease; "sudden" decreases in attention, thinking, concentration, and other cerebral functions; cerebral demyelination; among others.

The term "expression" is used herein in its broadest meaning and comprises the production of RNA or of RNA and protein. With respect to RNA, the term "expression" or "translation" relates in particular to the production of peptides or proteins. Expression may be transient or may be stable.

The term "translation" in the context of the present invention relates to a process at the ribosome, wherein an mRNA strand controls the assembly of an amino acid sequence to generate a protein or a peptide.

As used herein, "disease", "disorder" and "condition" are used interchangeably, to indicate an abnormal state in a subject.

As used herein, the term "about" or "~" means a variability of 10% from the reference given, unless otherwise specified.

The term "regulation" or variations thereof as used herein refers to the ability of a composition to inhibit one or more components of a biological pathway.

By "administering" as used in the methods means delivering the composition to the target selected cell which is characterized by a defect in the ABCD1 gene. In one embodiment, the method involves delivering the composition by intrathecal injection. In another embodiment, intracerebroventricular (ICV) injection to the subject is employed. In another embodiment, intrathecal-lumbar (IT-L) injection to the subject is employed. In still another method, intravascular injections may be employed. In another embodiment, intramuscular injection is employed. Generally, intrathecal administration is used. Still other methods of administration may be selected by one of skill in the art given this disclosure.

By "administering" or "route of administration" is delivery of composition described herein, with or without a pharmaceutical carrier or excipient, of the subject. Routes of administration may be combined, if desired. In some embodiments, the administration is repeated periodically. The pharmaceutical compositions described herein are designed for delivery to subjects in need thereof by any suitable route or a combination of different routes. In some embodiments, direct delivery to the brain (optionally via intrathecal, ICV or IT-L injection), or delivery via systemic routes is employed, e.g., intravascular, intraarterial, intraocular, intravenous, intramuscular, subcutaneous, intradermal, and other parental routes of administration. The nucleic acid molecules, the expression cassette and/or vectors described herein may be delivered in a single composition or multiple compositions. Optionally, two or more different AAV may be delivered, or multiple viruses [see, e.g., WO20 2011/126808 and WO 2013/049493] In another embodiment, multiple viruses may contain different replication-defective viruses (e.g., AAV and adenovirus), alone or in combination with proteins.

As used herein, the terms "intrathecal delivery" or "intrathecal administration" refer to a route of administration for drugs via an injection into the spinal canal, more specifically into the subarachnoid space so that it reaches the cerebrospinal fluid (CSF). Intrathecal delivery may include lumbar puncture, intraventricular (including intracerebroventricular (ICV)), suboccipital/intracisternal, and/or C 1-2 puncture. For example, material may be introduced for diffusion throughout the subarachnoid space by means of lumbar puncture. In another example, injection may be into the cisterna magna.

As used herein, the terms "intracisternal delivery" or "intracisternal administration" refer to a route of administration for drugs directly into the cerebrospinal fluid of the cisterna magna cerebellomedularis, more specifically via a suboccipital puncture or by direct injection into the cisterna magna or via permanently positioned tube. A device which is useful for delivering the compositions described herein into cerebrospinal fluid is described in PCT/US2017/16133, which is incorporated herein by reference.

Other definitions appear in context throughout this disclosure.

Compositions and Methods

The invention provides improved AAV constructs (such as rAAV vector and rAAV genome vector) and cells and compositions containing wherein such AAV constructs contain a nucleic acid sequence encoding human ABCD1 protein (AAV-ABCD1 construct or AAV-hABCD1 construct), wherein such improved AAV-ABCD1 constructs may possess one or more of the following advantages: improved safety, improved packageability, enhanced ABCD1 expression levels, improved potency, improved stability, or reduced potential to express non-self-antigens.

Compositions and methods of the invention provide treatments for X-linked adrenoleukodystrophy (X-ALD) caused by mutations in the ABCD1 gene. Targeted, specific delivery of the ABCD1 gene to the CNS is expected to address the symptoms of adrenoleukodystrophy and/or adrenomyeloneuropathy. This can be achieved by administering an adeno-associated virus (AAV) vector encoding ABCD1. Described herein are exemplary AAV-hABCD1 vectors, which is sometimes referred to herein as AAV-ABCD1. The use of these terms is interchangeable. In addition, alternate embodiments are contemplated utilizing the components as described herein.

In certain embodiments of this invention, compositions comprising the subject DNA constructs or compositions containing are used for the treatment and/or prevention of adrenoleukodystrophy and/or adrenomyeloneuropathy and symptoms associated therewith in subjects in need thereof which symptoms include the accumulation of high levels of saturated, very long chain fatty acids (VLCFA) in plasma and tissues of the brain, spinal cord, and adrenal cortex, adrenomyeloneuropathy (AMN), and peripheral neuropathy due to affected dorsal root ganglia neurons.

The invention also provides methods of making such improved AAV constructs which contain a nucleic acid sequence encoding human ABCD1 protein (AAV-ABCD1 construct), and which constructs may possess one or more of the following advantages: improved safety, improved packageability, enhanced ABCD1 expression levels, improved stability, or reduced potential to express non-self-antigens which may be used for the treatment and/or prevention of adrenoleukodystrophy (ALD) and/or adrenomyeloneuropathy (AMN) in subjects in need thereof.

The invention also provides methods of delivering such improved AAV constructs by, e.g., intrathecal, intracerebroventricular (ICV), intrathecal-lumbar (IT-L), intravascular, intramuscular, or intracisternal administration which contain a nucleic acid sequence encoding human ABCD1 protein (AAV-ABCD1 construct), which constructs may possess one or more of the following advantages: improved safety, improved packageability, enhanced ABCD1 expression levels, improved stability, or reduced potential to express non-self-antigens for the treatment and/or prevention of adrenoleukodystrophy and/or adrenomyeloneuropathy in subjects in need thereof.

In some embodiments as described herein such improved AAV-ABCD1 constructs will lack a woodchuck post-transcriptional regulatory element (WPRE).

In other embodiments as described herein such improved AAV-ABCD1 constructs will comprise a modified woodchuck post-transcriptional regulatory element (WPRE) that comprises at least one mutation which eliminates expression of the X protein or which results in the expression of an inactivated or non-functional X protein, e.g., a truncated X protein.

In some embodiments as described herein such improved AAV-ABCD1 constructs will lack a woodchuck post-transcriptional regulatory element (WPRE).

In other embodiments as described herein such improved AAV-ABCD1 constructs will comprise a modified woodchuck post-transcriptional regulatory element (WPRE) that comprises at least one mutation which eliminates expression of the X protein or which results in the expression of an inactivated or non-functional X protein, e.g., a truncated. X protein.

It is a specific object of the invention to provide novel recombinant AAV DNA constructs which is understood herein to encompass rAAV viral vectors with rAAV viral vector genome-encoding polynucleotides which express therapeutically sufficient amounts of the ALD protein in vivo which lack a potentially oncogenic transgene expression enhancer, such as a woodchuck post-transcriptional regulatory element (WPRE) or which comprise a WPRE which is modified to reduce or eliminate X protein expression and/or to result in expression of a variant of the X protein which is inactive (non-oncogenic).

It is a specific object of the invention to provide an isolated polynucleotide comprising a recombinant adeno-associated virus (rAAV) vector genome which may be packaged in viral capsids to form a rAAV virion, wherein said rAAV vector genome comprises or consists of: (a) a 5' AAV inverted terminal repeat (ITR); (b) an expression cassette, wherein the expression cassette comprises at least (i) a promoter active in target cells, operably linked to (ii) a polynucleotide encoding an ATP-binding cassette, sub-family D, member 1 (ABCD1) polypeptide, (iii) one or more terminators and (iv) one or more poly A signal downstream of said ABCD1-encoding polynucleotide; and (c) a 3' ITR. The rAAV vector genome may not comprise a woodchuck post-transcriptional regulatory element (WPRE) or may comprises a modified WPRE comprising at least one mutation which results in the X protein not being expressed or being expressed in an inactivated form (WPREx-inact).

In some instances, in the isolated polynucleotide provided by the invention, the 5' and 3' ITR, may be derived from the 5' and 3' ITR of any one of AAV1, AAV2, AAV3, AAV4, AAV5, AAV6, AAV7, AAV8, AAV9, AAVrh.10 (also referred to herein as AAVrh10) serotypes, or a combination thereof.

In some instances, the 5' and 3' ITR may be derived from the 5' and 3' ITR of AAV2, AAV9, or AAVrh.10.

In some instances, the isolated polynucleotide does not comprise a woodchuck post-transcriptional regulatory element (WPRE).

In some instances, the isolated polynucleotide comprises a modified WPRE (WPREx-inact) comprising at least one mutation which results in the X protein not being expressed or being expressed in an inactivated form.

In some instances, in the isolated polynucleotide provided by the invention, (i) the 5' ITR is derived from the 5' ITR of AAV2; and/or (ii) the 3' ITR is derived from the 3' ITR of AAV2. Exemplary 5' ITR and 3' ITR sequences of AAV2 include but are not limited to the reference 5' ITR and 3' ITR sequences of SEQ ID NOS: 601 and 602, respectively, which are in an exemplary AAV2 complete genome reference sequence provided by Accession number: NC_001401.2. In some instances, in the isolated polynucleotide provided by the invention, (i) the 5' ITR may comprise the nucleic acid sequence of SEQ ID NO: 301, 401, 601, 611, 10001, 10101, or 10201; and/or (ii) the 3' ITR comprises the nucleic acid sequence of SEQ ID NO: 302, 402, 602, 612, 10018, 10118, or 10218.

In some instances, in the isolated polynucleotide provided by the invention, (i) the 5' ITR may be a truncated form of the 5' ITR of AAV2; and/or (ii) the 3' ITR may be a truncated form of the 3' ITR of AAV2. For example, (i) the truncated form of the 5' ITR may comprise the nucleic acid sequence of SEQ ID NO: 2, 10501, 11001, 11101, 11201, 11301, 11501, or 11701; and/or (ii) the truncated form of the 3' ITR may comprise the nucleic acid sequence of SEQ ID NO: 28, 10518, 11018, 11118, 11218, 11318, 11518, or 11718.

In some instances, the target cells of the rAAV vector which comprise the vector genome may be neurons or glial cells.

In some instances, the promoter contained in the vector genome may be selected from a cytomegalovirus (CMV) immediate early promoter, a viral simian virus 40 (SV40) (e.g., early or late), a Moloney murine leukemia virus (MoMLV) LTR promoter, a Rous sarcoma virus (RSV) LTR, a herpes simplex virus (HSV) (thymidine kinase) promoter, H5, P7.5, and PI 1 promoters from vaccinia virus, an elongation factor 1-alpha (EF1a) promoter, early growth response 1 (EGR1), ferritin H (FerH), ferritin L (FerL), Glyceraldehyde 3-phosphate dehydrogenase (GAPDH), eukaryotic translation initiation factor 4A1 (EIF4A1), heat shock 70 kDa protein 5 (HSPA5), heat shock protein 90 kDa beta, member 1 (HSP90B1), heat shock protein 70 kDa (HSP70), β-kinesin (β-KIN), the human ROSA 26 locus, a ubiquitin C promoter (UBC), a phosphoglycerate kinase-1 (PGK) promoter, a chicken β-actin (CAG) promoter, a Cytomegalovirus enhancer/chicken β-actin (CBA) promoter, a β-glucuronidase (GUSB) promoter, a JeT promoter, a β-actin promoter, optionally a chicken β-actin promoter; a tissue-specific promoter, a B29 promoter, a runt transcription factor (CBFa2) promoter, a CD14 promoter, a CD43 promoter, an CD45 promoter, a CD68 promoter, a CYP450 3A4 promoter, a desmin promoter, an elastase 1 promoter, an endoglin promoter, a fibroblast specific protein 1 promoter (FSP1) promoter, a fibronectin promoter, a fms-related tyrosine kinase 1 (FLT1) promoter, a glial fibrillary acidic protein (GFAP) promoter, an insulin promoter, an integrin, alpha 2b (ITGA2B) promoter, intracellular adhesion molecule 2 (ICAM-2) promoter, an interferon beta (IFN-β) promoter, a keratin 5 promoter (keratinocyte expression), a myoglobin (MB) promoter, a myogenic differentiation 1 (MYOD1) promoter, a nephrin promoter, a bone gamma-carboxyglutamate protein 2 (OG-2) promoter, an 3-oxoacid CoA transferase 2B (Oxct2B) promoter, a surfactant protein B (SP-B) promoter, a synapsin promoter, a Wiskott-Aldrich syndrome protein (WASP) promoter, or an MND promoter. An exemplary sequence of an EF1a promoter may be provided by, e.g., Accession No: J04617. An exemplary sequence of a UBC promoter may be provided by, e.g., Accession No: NG_027722.2. An exemplary sequence of a Cytomegalovirus enhancer/chicken β-actin promoter may be provided by, e.g., Accession No: NC_006273/X00182. An exemplary sequence of a JeT promoter may be provided by, e.g., Tornøe J, Kusk P, Johansen T E, Jensen P R. "Generation of a synthetic mammalian promoter library by modification of sequences spacing transcription factor binding sites", Gene. 2002 Sep. 4; 297(1-2):21-32 (doi: 10.1016/s0378-1119(02)00878-8; PMID: 12384282). An exemplary sequence of a GUSB promoter may be provided by, e.g., Accession No: M65002.

In some instances, the promoter contained in the viral genome may comprise a chicken β-actin promoter (also referred to as CBA promoter herein), optionally wherein the chicken β-actin promoter comprises the nucleic acid sequence of SEQ ID NO: 10, 10007, 10107, 10207, 10507, 11007, 11107, 11207, 11307, 11507, or 11707, or a nucleic acid sequence having at least 95%, 96%, 97%, 98%, or 99% identity thereto.

In some instances, the promoter contained in the viral genome may be operably linked to an enhancer, selected from a CMV enhancer, RSV enhancer, Alpha fetoprotein enhancer, TTR minimal promoter/enhancer, LSP enhancer, APB enhancer, ABPS enhancer, alpha mic/bik enhancer, TTR enhancer, en34 enhancer, or a ApoE enhancer.

In some instances, the promoter contained in the viral genome may be operably linked to an enhancer, optionally wherein the enhancer is a CMV enhancer or a myeloproliferative sarcoma virus enhancer.

In some instances, the promoter contained in the viral genome is operably linked to a CMV enhancer, optionally wherein the CMV enhancer comprises the nucleic acid sequence of SEQ ID NO: 7, 10005, 10105, 10205, 10505, 11005, 11105, 11205, 11305, 11505, or 11705, or a nucleic acid sequence having at least 95%, 96%, 97%, 98%, or 99% identity thereto.

In some instances, the promoter contained in the viral genome comprises a CMV enhancer, a chicken β-actin promoter, β-actin exon, a chimeric intron, a rabbit beta-globin exon, optionally in the direction from the 5' end to the 3' end.

In certain instances, (i) the CMV enhancer may comprise the nucleic acid sequence of SEQ ID NO: 7, 10005, 10105, 10205, 10505, 11005, 11105, 11205, 11305, 11505, or 11705, or a nucleic acid sequence having at least 95%, 96%, 97%, 98%, or 99% identity thereto; (ii) the chicken β-actin promoter may comprise the nucleic acid sequence of SEQ ID NO: 10, 10007, 10107, 10207, 10507, 11007, 11107, 11207, 11307, 11507, or 11707, or a nucleic acid sequence having at least 95%, 96%, 97%, 98%, or 99% identity thereto; (iii) the β-actin exon may comprise the nucleic acid sequence of SEQ ID NO: 11, 10008, 10108, 10208, 10508, 11008, 11108, 11208, 11308, 11508, or 11708, or a nucleic acid sequence having at least 95%, 96%, 97%, 98%, or 99% identity thereto; (iv) the chimeric intron may comprise the nucleic acid sequence of SEQ ID NO: 12, 10009, 10109, 10209, 10509, 11009, 11109, 11209, 11309, 11509, or 11709, or a nucleic acid sequence having at least 95%, 96%, 97%, 98%, or 99% identity thereto; and/or the rabbit beta-globin exon may comprise the nucleic acid sequence of SEQ ID NO: 10085, 10185, 10285, 10585, 11085, 11185, 11285, 11385, 11585, or 11785, or a nucleic acid sequence having at least 95%, 96%, 97%, 98%, or 99% identity thereto.

In some instances, the ABCD1 polypeptide encoded by the rAAV vector genome may comprise the amino acid sequence encoded by the nucleic acid sequence of SEQ ID NO: 14, 204, 304, 404, 501, 502, 503, 504, 505, 506, 507, 508, 509, 5010, 10012, 10112, 10212, 10512, 11012, 11112, 11212, 11312, 11512, or 11712, or a nucleic acid sequence having at least 95%, 96%, 97%, 98%, or 99% identity thereto.

In some instances, the ABCD1 coding sequence comprised in the rAAV vector genome may contain a reduced number of alternative open reading frames relative to the nucleic acid sequence of SEQ ID NO: 204 or does not contain any alternative open reading frames.

In some instances, the ABCD1 coding sequence may be predominantly (over 50, 60, 70, 80, 90 or 95%) or entirely of comprised of human preferred codons.

In some instances, the ABCD1-encoding polynucleotide comprises the nucleic acid sequence of SEQ ID NO: 14, 204, 304, 404, 501, 502, 503, 504, 505, 506, 507, 508, 509, 5010, 10012, 10112, 10212, 10512, 11012, 11112, 11212, 11312, 11512, or 11712, or a nucleic acid sequence having at least 95%, 96%, 97%, 98%, or 99% identity thereto.

In some instances, the rAAV vector genome further comprising a Kozak sequence immediately upstream of the ABCD1-encoding polynucleotide, and optionally the Kozak sequence may comprise the nucleic acid sequence of SEQ ID NO: 10511, 11211, or 11311 or any sequence representing an approach to the consensus sequence for optimal protein translation initiation: 'GCCRCCATGG'.

In some instances, the rAAV vector genome comprises one or more terminator(s) individually selected from UAG, UAA, and/or UGA. In certain instances, the rAAV vector genome may comprise a terminator comprising the nucleic acid sequence of SEQ ID NO: 10071, 10171, 10271, 10571, 11071, 11171, 11271, 11371, 11571, or 11771. In certain instances, the rAAV vector genome may further comprise another terminator comprising the nucleic acid sequence of SEQ ID NO: 10572, 11272, or 11372.

In some instances, the poly A signal contained in the rAAV vector genome may comprise at least one polyA signal consisting of bGH, hGH, SV40, RGB, mRGB, or a synthetic poly A signal. In some instances, the poly A signal contained in the rAAV vector genome may comprise two or more poly A signals operably linked downstream to the ABCD1-encoding polynucleotide.

In some instances the polyA signal contained in the rAAV vector genome may comprise an SV40 poly A signal, and optionally the SV40 poly A signal may comprise the nucleic acid sequence of SEQ ID NO: 27, 10014, 10114, 10214, 10514, 11014, 11214, or 11714, or a nucleic acid sequence having at least 95%, 96%, 97%, 98%, or 99% identity thereto.

In some instances, the poly A signal contained in the rAAV vector genome may comprise an bGH poly A signal, and optionally the bGH poly A signal may comprise the nucleic acid sequence of SEQ ID NO: 10016, 10116, 10216, 11016, 11116, 11216, 11316, 11516, or 101716, or a nucleic acid sequence having at least 95%, 96%, 97%, 98%, or 99% identity thereto.

In some instances, the poly A signal contained in the rAAV vector genome may comprise the nucleic acid sequence of SEQ ID NO: 206, 306, 405, 10035, 10135, 10235, 10535, 11035, 11135, 11235, 11335, 11535, or 11735, or a nucleic acid sequence having at least 95%, 96%, 97%, 98%, or 99% identity thereto.

In some instances, in the rAAV vector genome, (a) the 5' ITR may comprise the nucleic acid sequence of SEQ ID NO: 301, 401, 10001, 10101, 10201, 2, 10501, 11001, 11101, 11201, 11301, 11501, or 101701; (b), in the expression cassette, (i) the promoter may comprise the nucleic acid sequence of SEQ ID NO: 10, 10007, 10107, 10207, 10507, 11007, 11107, 11207, 11307, 11507, or 11707, 303, 403, (ii) the ABCD1-encoding polynucleotide may comprise the nucleic acid sequence of SEQ ID NO: 14, 204, 304, 404, 501, 502, 503, 504, 505, 506, 507, 508, 509, 5010, 10012, 10112, 10212, 10512, 11012, 11112, 11212, 11312, 1512, or 11712, and (iii) the poly A signal may comprise the nucleic acid sequence of SEQ ID NO: 27, 10014, 10114, 10214, 10514, 11014, 11214, 11714, 10016, 10116, 10216, 11016, 11116, 11216, 11316, 11516, 11716, 306, 405, 10035, 10135, 10235, 11035, 11235, or 11735; and (c) the 3' ITR may comprise the nucleic acid sequence of SEQ ID NO: 302, 402, 602, 612, 28, 10018, 10118, 10218, 10518, 11018, 11118, 11218, 11318, 11518, or 11718.

In certain instances, the rAAV vector genome may comprise or consist of the nucleic acid sequence of SEQ ID NO: 300, 400, 10050, 10150, 10250, 10550, 11050, 11150, 11250, 11350, 11550, or 11750, the nucleotides 1-3713 of the nucleic acid sequence of SEQ ID NO: 100, or SEQ ID NO: 10060, 10160, 10260, 10560, 11060, 11160, 11260, 11360, 11560, or 101760 or a nucleic acid sequence having at least 95%, 96%, 97%, 98%, or 99% identity thereto.

In certain instances, the rAAV vector genome further comprises a modified woodchuck post-transcriptional regulatory element (WPRE) that comprises at least one mutation which eliminates expression of the X protein or which results in the expression of an inactivated or non-functional X protein (WPREx-inact). For example, the inactivated or non-functional X protein is a truncated X protein. In a specific example, the modified WPRE comprises the nucleic acid sequence of SEQ ID NO: 305 or 10075.

In certain instances, the isolated polynucleotide provided by the invention may comprise the rAAV vector genome which comprises or consists of the nucleic acid sequence of SEQ ID NO: 300, 10050, or 10060.

In certain instances, the isolated polynucleotide provided by the invention may be a plasmid, preferably a high-copy plasmid (500-1000 copies/cell) in a host cell under specific growth conditions (e.g., pUC18, pUC19, pUC57, or pUC118). The plasmid may optionally encode an antibiotic-resistance gene, which may optionally be a kanamycin-resistance gene. In particular examples, the plasmid may comprise a pUC57 or pUC118 backbone. In certain instances, the isolated polynucleotide provided by the invention may be a plasmid which comprises, consists of, or is derived from the plasmid pSBT101, pOB1005, pOB1010, pOB1011, pOB1012, pOB1013, pOB1015, or pOB1017, or the plasmid that encodes the genome of AAV-CBA-ABCD1-WPRE(Xinact).

In certain instances, the isolated polynucleotide provided by the invention may be a plasmid which comprises or consists of the nucleic acid sequence of SEQ ID NO: 100, 10000, 10100, 10500, 11000, 11100, 11200, 11300, 11500, or 11700, or a nucleic acid sequence having at least 95%, 96%, 97%, 98%, or 99% identity thereto.

It is a specific object of the invention to provide a composition comprising: (A) the isolated polynucleotide according to any of the polynucleotide described above, optionally further comprising any one or more of: (B) a transfection reagent; (C) a polynucleotide which comprises an AAV capsid (cap) gene; (D) a polynucleotide which comprises an AAV replication (rep) gene; (E) a polynucleotide which comprises adenovirus helper genes selected from the group consisting of E1 region, E2 region, E4 region, and VA RNA region; and/or (F) a pharmaceutically acceptable carrier or excipient.

In some instances, the transfection reagent is polyethylenimine (PEI) or a PEI derivative such as PEIpro®. In some other instances, the transfection reagent may be Lipofectamine™ FuGENE®, or TransIT®. In some instances, (i) the AAV cap gene may be derived from the cap gene of AAV1, AAV2, AAV3, AAV4, AAV5, AAV6, AAV7, AAV8, AAV9, and AAVrh.10, preferably of AAV2, AAV9, or AAVrh.10; and/or (ii) the AAV rep gene may be derived from the rep gene of AAV1, AAV2, AAV3, AAV4, AAV5, AAV6, AAV7, AAV8, AAV9, and AAVrh.10, preferably of AAV2, AAV9, or AAVrh.10.

In some embodiments, the rep gene and the cap gene may be provided by a separate plasmid to a packaging cell. In some embodiments, the packaging cell is engineered to express the cap gene and/or the rep gene. In certain instances, the rep gene may be transcribed by (i.e., transcription is controlled by) the p5 and/or p40 promoter and the cap gene may be transcribed by the p40 promoter.

In some embodiments, the rep gene and the cap gene may be provided by a Rep/Cap plasmid. In certain embodiments, the Rep/Cap plasmid comprises a p5 promoter, p19 promoter, and p40 promoter. In certain instances, the rep gene may be transcribed by the p5 and/or the p40 promoter and the cap gene may be transcribed by the p40 promoter.

In some embodiments, the Rep/Cap plasmid may be entirely derived from AAV1, AAV2, AAV3, AAV4, AAV5, AAV6, AAV7, AAV8, AAV9, or AAVrh.10, while in some embodiments, the Rep/Cap plasmid may be of a hybrid serotype, such as AAV2/9, which comprise elements from AAV2 and elements from AAV9.

In certain embodiments, when the Rep/Cap plasmid is of AAV2/9 serotype, the Rep gene may be of AAV2 and the Cap gene may be of AAV9.

In such embodiments, the Rep/Cap plasmid may comprise an AAV2 p5 promoter (which may comprise the nucleic acid sequence of SEQ ID NO: 710), an AAV2 p19 promoter (which may comprise the nucleic acid sequence of SEQ ID NO: 720), and a AAV p40 promoter (which may comprise the nucleic acid sequence of SEQ ID NO: 730).

In some embodiments the capsid (cap) gene may be the capsid gene or a variant thereof of AAV serotypes AAV1, AAV2, AAV3, AAV4, AAV5, AAV6, AAV7, AAV8, AAV9, or AAVrh.10 encoding for VP1, VP2, and/or VP3 capsid proteins.

In some embodiments, the cap gene products are transcribed by the AAV p40 promoter. In certain embodiments, the AAV p40 promoter may comprise the nucleic acid sequence of SEQ ID NO: 730.

In certain embodiments, the capsid gene may be or may be derived from the capsid gene of AAV2, AAV9 or AAV10rh.10.

In some embodiments, when the capsid gene (Cap gene) is derived from that of AAV9, three capsid gene products VP1, VP2, and VP3 of AAV9 may be encoded. In certain instances, the VP1, VP2, and VP3 of AAV9 may be transcribed by the p40 promoter. In certain instances, the VP1 AAV9 may comprise the amino acid sequences of SEQ ID NO: 731. In certain instances, the VP2 of AAV9 may comprise the amino acid sequences of SEQ ID NO: 732. In certain instances, the VP3 of AAV9 may comprise the amino acid sequences of SEQ ID NO: 733.

In some embodiments, when the capsid gene (Cap gene) is or is derived from that of AAV2, three capsid gene products VP1, VP2, and VP3 of AAV2 may be produced. In certain instances, the VP1 of AAV2 may comprise the amino acid sequences of SEQ ID NO: 831. In certain instances, the VP2 of AAV2 may comprise the amino acid sequences of SEQ ID NO: 832. In certain instances, the VP3 of AAV2 may comprise the amino acid sequences of SEQ ID NO: 833.

In some embodiments, when the capsid gene (Cap gene) is derived from that of AAVrh.10, three capsid gene products VP1, VP2, and VP3 of AAVrh.10 may be produced. In certain instances, the VP1 of AAVrh.10 may comprise the amino acid sequences of SEQ ID NO: 931. In certain instances, the VP2 of AAVrh.10 may comprise the amino acid sequences of SEQ ID NO: 932. In certain instances, the VP3 of AAVrh.10 may comprise the amino acid sequences of SEQ ID NO: 933.

In some instances, an exemplary AAVrh.10 capsid sequence may be provided by, e.g., GeneBank #AY243015 (nucleic acid sequence) and/or Accession No. AAO88201.1 (amino acid sequence) and/or by, e.g., Gao G. et al., *J Virol.* 2004 June; 78(12):6381-8.

In some embodiments the replication gene may be the replication gene or a variant thereof of AAV serotypes AAV1, AAV2, AAV3, AAV4, AAV5, AAV6, AAV7, AAV8, AAV9, or AAVrh.10 encoding for Rep 78, Rep 68, Rep 52, and/or Rep 40 proteins. In some embodiments, the replicon gene(s) may be transcribed by the p5 promoter and/or the p19 promoter.

In some embodiments, the replication gene may be the replication gene or a variant thereof of AAV2, AAV9, or AAVrh.10.

In certain embodiments, two replication gene products, REP78 and REP68, may be transcribed by the p5 promoter. In certain embodiments two replication gene products, REP52 and REP40, may be transcribed by the p19 promoter.

In some embodiments, when the replication gene (rep gene) is or is derived from that of AAV2, the replication gene products Rep78, Rep68, Rep52, and/or Rep40 of AAV2 may be produced. In certain instances, the Rep78 and/or Rep68 of AAV2 may be transcribed by the AAV2 p5 promoter, and the Rep52 and/or Rep40 may be transcribed by the AAV2 p19 promoter.

In certain embodiments, the AAV2 p5 promoter may comprise the nucleic acid sequence of SEQ ID NO: 710 and/or the AAV2 p19 promoter may comprise the nucleic acid sequence of SEQ ID NO: 720.

In certain embodiments, the gene product Rep78 of AAV2 may comprise the amino acid sequences of SEQ ID NO: 711. In certain instances, the gene product Rep68 of AAV2 may comprise the amino acid sequences of SEQ ID NO: 712. In certain instances, the gene product Rep52 of AAV2 may comprise the amino acid sequences of SEQ ID NO: 721. In certain instances, the gene product Rep40 of AAV2 may comprise the amino acid sequences of SEQ ID NO: 722.

In specific embodiments, when the Rep/Cap plasmid is an AAV2/9 plasmid, such as the plasmid referred to herein as "pAAV2/9", the plasmid may comprise: an AAV2 p5 promoter (SEQ ID NO: 710) from which AAV2 REP78 (SEQ ID NO: 711) and AAV2 REP68 (SEQ ID NO: 712) may be produced; an AAV2 p19 promoter (SEQ ID NO: 720) from which AAV2 REP52 (SEQ ID NO: 721) and AAV2 REP40 (SEQ ID NO: 722) may be produced; and a AAV p40 promoter (SEQ ID NO: 730) from which AAV9 VP1 (SEQ ID NO: 731), AAV9 VP2 (SEQ ID NO: 732), and AAV9 VP3 (SEQ ID NO: 733) may be produced. In some specific instances, the full construct sequence of such a pAAV2/9 plasmid may have the nucleic acid sequence of SEQ ID NO: 700.

In certain instances, in a pAAV2/9 Rep/Cap plasmid, the REP40 and REP68 genes may share a second exon that resides within the CAP VP1 sequence. In certain instances, there may be a variation of the last several amino acids (e.g., three amino acids) encoded by the small second exon of REP 40 and REP 68. For example, when REP40 and REP68 comprise the amino acid sequence of SEQ ID NO: 722 and 712, respectively, both the REP 40 and REP 68 products end with the amino acid sequence LARGQP. This differs from the REP 40 and REP 68 sequences of natural AAV2, both of which end with the amino acid sequence LARGHSL.

In some instances, the AAV cap gene may encode the amino acid sequence of SEQ ID NOS: 731, 732, and/or 733, or an amino acid sequence having at least 95%, 96%, 97%, 98%, 99% identity thereto.

In some instances, the AAV cap gene may encode the amino acid sequence of SEQ ID NOS: 831, 832, and/or 833, or an amino acid sequence having at least 95%, 96%, 97%, 98%, 99% identity thereto.

In some instances, the AAV cap gene may encode the amino acid sequence of SEQ ID NOS: 931, 932, and/or 933, or an amino acid sequence having at least 95%, 96%, 97%, 98%, 99% identity thereto.

In some instances, the AAV rep gene may encode the amino acid sequence of SEQ ID NOS: 711, 712, 721, and/or 722, or an amino acid sequence having at least 95%, 96%, 97%, 98%, or 99% identity thereto.

In some embodiments, a polynucleotide which comprises one or more helper gene(s), such as one or more adenovirus helper gene(s), one or more herpes simplex virus helper gene(s), one or more papillomavirus helper gene(s), and/or one or more vaccinia virus helper gene(s), may be comprised in a composition which may be used for producing an rAAV viral vector according to the present invention.

In some embodiments, when one or more adenovirus helper gene(s) is contained, the adenovirus helper gene(s) may be derived from Adenovirus 5 (Ad5) and/or Adenovirus 2 (Ad2). In some instances, the adenovirus helper gene(s) may be derived from wild-type (WT) Ad5, and in certain instances, the WT Ad5 may comprise a genome comprising the nucleic acid sequence of SEQ ID NO: 2000. In some instances, the adenovirus helper gene(s) may be derived from wild-type (WT) Ad2, and in certain instances, the WT Ad2 may comprise a genome comprising the nucleic acid sequence of SEQ ID NO: 3000.

In some embodiments, when one or more adenovirus helper gene(s) is contained, the adenovirus helper gene(s) may comprise the E1 region, E2 region, E4 region, and/or VA RNA region. In some embodiments, the adenovirus helper gene(s) may comprise the VA RNA region, E2 region, and E4 region.

In some embodiments, one or more adenovirus helper gene(s) may be provided by an AAV helper virus, which may be provided by an AAV virus helper plasmid (or simply referred to as "virus helper plasmid" herein).

In some embodiments, one or more Ad5 helper gene(s) may be provided by an Ad5 helper virus, which may be provided by an Ad5 virus helper plasmid. Non-limiting examples of such an Ad5 virus helper plasmid include the plasmid referred to herein as pALD-X80.

In some embodiments, an Ad5 virus helper plasmid may comprise an Ad5 VA RNA region, an Ad5 E2 region, and/or an Ad5 E4 region. In some instances, the Ad5 VA RNA region may comprise the nucleic acid sequence of SEQ ID NO: 2010. In some instances, the Ad5 E2 region may comprise the nucleic acid sequence of SEQ ID NO: 2020. In some instances, the Ad5 E4 region may comprise the nucleic acid sequence of SEQ ID NO: 2030. For example, an exemplary plasmid, pALD-X80, comprises these sequences.

In some embodiments, an Ad5 VA RNA region may comprise an Ad5 VA-RNA region I (VA RNA I) and an Ad5 VA-RNA region II (VA RNA II). In some instances, the Ad5 VA-RNA region I (VA RNA I) may comprise the nucleic acid sequence of SEQ ID NO: 2011. In some instances, the Ad5 VA-RNA region II (VA RNA II) may comprise the nucleic acid sequence of SEQ ID NO: 2012.

In some embodiments, an Ad5 E2 region may encode Hexon (C-terminal fragment); 23K endoprotease; E2A/DBP; Hexon Assembly (100K); Hexon Assembly (33K); Hexon Assembly (22K); and/or Hexon-associated precursor. In some instances, such Hexon (C-terminal fragment) may comprise the amino acid sequence of SEQ ID NO: 2021. In some instances, such 23K endoprotease may comprise the amino acid sequence of SEQ ID NO: 2022. In some instances, such E2A/DBP may comprise the amino acid sequence of SEQ ID NO: 2023. In some instances, such Hexon Assembly (100K) may comprise the amino acid sequence of SEQ ID NO: 2024. In some instances, such Hexon Assembly (33K) may comprise the amino acid sequence of SEQ ID NO: 2025. In some instances, such Hexon Assembly (22K) may comprise the amino acid sequence of SEQ ID NO: 2026. In some instances, such Hexon-associated precursor may comprise the amino acid sequence of SEQ ID NO: 2027.

In some embodiments, an Ad5 E4 region may encode: Fiber; E4 ORF1; E4 ORF2; E4 ORF3; E4 ORF4; E4 ORF6; and/or E4 ORF6/7. In some instances, Fiber may comprise the amino acid sequence of SEQ ID NO: 2031. In some instances, E4 ORF1 may comprise the amino acid sequence of SEQ ID NO: 2032. In some instances, E4 ORF2 may comprise the amino acid sequence of SEQ ID NO: 2033. In some instances, E4 ORF3 may comprise the amino acid sequence of SEQ ID NO: 2034. In some instances, E4 ORF4 may comprise the amino acid sequence of SEQ ID NO:

2035. In some instances, E4 ORF6 may comprise the amino acid sequence of SEQ ID NO: 2036. In some instances, E4 ORF6/7 may comprise the amino acid sequence of SEQ ID NO: 2037.

In some specific embodiments, one or more adenovirus helper gene(s) may be provided by the pALD-X80 plasmid or an Ad5 virus helper plasmid.

In some specific embodiments an Ad5 virus helper plasmid may comprise: the Ad5 Region VA-RNA (SEQ ID NO: 2010) containing VA-RNA region (VA RNA I) (SEQ ID NO: 2011) and/or VA-RNA region (VA RNA II) (SEQ ID NO: 2012); Ad5 Region E2 (SEQ ID NO: 2020) encoding Hexon (C-terminal fragment) (SEQ ID NO: 2021), 23K endoprotease (SEQ ID NO: 2022), E2A/DBP (SEQ ID NO: 2023), Hexon Assembly (100K) (SEQ ID NO: 2024), Hexon Assembly (33K) (SEQ ID NO: 2025), Hexon Assembly (22K) (SEQ ID NO: 2026), and Hexon-associated precursor (SEQ ID NO: 2027); and Ad5 Region E4 (SEQ ID NO: 2030) encoding Fiber (SEQ ID NO: 2031), E4 ORF1 (SEQ ID NO: 2032), E4 ORF2 (SEQ ID NO: 2033), E4 ORF3 (SEQ ID NO: 2034), E4 ORF4 (SEQ ID NO: 2035), E4 ORF6 (SEQ ID NO: 2036), and/or E4 ORF6/7 (SEQ ID NO: 2037).

pALD-X80 comprises: the Ad5 Region VA-RNA (SEQ ID NO: 2010) containing VA-RNA region (VA RNA I) (SEQ ID NO: 2011) and/or VA-RNA region (VA RNA II) (SEQ ID NO: 2012); Ad5 Region E2 (SEQ ID NO: 2020) encoding Hexon (C-terminal fragment) (SEQ ID NO: 2021), 23K endoprotease (SEQ ID NO: 2022), E2A/DBP (SEQ ID NO: 2023), Hexon Assembly (100K) (SEQ ID NO: 2024), Hexon Assembly (33K) (SEQ ID NO: 2025), Hexon Assembly (22K) (SEQ ID NO: 2026), and Hexon-associated precursor (SEQ ID NO: 2027); and Ad5 Region E4 (SEQ ID NO: 2030) encoding Fiber (SEQ ID NO: 2031), E4 ORF1 (SEQ ID NO: 2032), E4 ORF2 (SEQ ID NO: 2033), E4 ORF3 (SEQ ID NO: 2034), E4 ORF4 (SEQ ID NO: 2035), E4 ORF6 (SEQ ID NO: 2036), and/or E4 ORF6/7 (SEQ ID NO: 2037).

In some embodiments, one or more Ad2 helper gene(s) may be provided by an Ad2 helper virus, which may be provided by an Ad2 virus helper plasmid. Non-limiting examples of such an Ad2 virus helper plasmid may include the plasmid referred to herein as pHELP-KanV4.

In some embodiments, an Ad2 virus helper plasmid may comprise an Ad2 VA RNA region, an Ad2 E2 region, and/or an Ad2 E4 region. In some instances, the Ad2 VA RNA region may comprise the nucleic acid sequence of SEQ ID NO: 3010. In some instances, the Ad2 E2 region may comprise the nucleic acid sequence of SEQ ID NO: 3020. In some instances, the Ad2 E4 region may comprise the nucleic acid sequence of SEQ ID NO: 3030. For example, an exemplary plasmid, pHELP-KanV4, comprises these sequences.

In some embodiments, an Ad2 VA RNA region may comprise an Ad2 VA-RNA region I (VA RNA I) and an Ad2 VA-RNA region II (VA RNA II). In some instances, the Ad2 VA-RNA region I (VA RNA I) may comprise the nucleic acid sequence of SEQ ID NO: 3011. In some instances, the Ad2 VA-RNA region II (VA RNA II) may comprise the nucleic acid sequence of SEQ ID NO: 3012.

In some embodiments, an Ad2 E2 region may encode 23K endoprotease (C-terminal fragment); E2A/DBP; Hexon Assembly (100K); Hexon Assembly (33K); Hexon Assembly (22K); and/or Hexon-associated precursor. In some instances, such 23K endoprotease (C-terminal fragment) may comprise the amino acid sequence of SEQ ID NO: 3022. In some instances, such E2A/DBP may comprise the amino acid sequence of SEQ ID NO: 3023. In some instances, such Hexon Assembly (100K) may comprise the amino acid sequence of SEQ ID NO: 3024. In some instances, such Hexon Assembly (33K) may comprise the amino acid sequence of SEQ ID NO: 3025. In some instances, such Hexon Assembly (22K) may comprise the amino acid sequence of SEQ ID NO: 3026. In some instances, such Hexon-associated precursor may comprise the amino acid sequence of SEQ ID NO: 3027.

In some embodiments, an Ad2 E4 region may encode: E4 ORF1; E4 ORF2; E4 ORF3; E4 ORF4; E4 ORF6; and/or E4 ORF6/7. In some instances, In some instances, such E4 ORF1 may comprise the amino acid sequence of SEQ ID NO: 3032. In some instances, such E4 ORF2 may comprise the amino acid sequence of SEQ ID NO: 3033. In some instances, such E4 ORF3 may comprise the amino acid sequence of SEQ ID NO: 3034. In some instances, such E4 ORF4 may comprise the amino acid sequence of SEQ ID NO: 3035. In some instances, such E4 ORF6 may comprise the amino acid sequence of SEQ ID NO: 3036. In some instances, such E4 ORF6/7 may comprise the amino acid sequence of SEQ ID NO: 3037.

In some specific embodiments, one or more adenovirus helper gene(s) may be provided by the pHELP_KanV4 plasmid, an Ad2 virus helper plasmid.

In some specific embodiments an Ad2 virus helper plasmid may comprise: the Ad2 Region VA-RNA (SEQ ID NO: 3010) containing VA-RNA region (VA RNA I) (SEQ ID NO: 3011) and/or VA-RNA region (VA RNA II) (SEQ ID NO: 3012); Ad2 Region E2 (SEQ ID NO: 3020) encoding 23K endoprotease (C-terminal fragment) (SEQ ID NO: 3022), E2A/DBP (SEQ ID NO: 3023), Hexon Assembly (100K) (SEQ ID NO: 3024), Hexon Assembly (33K) (SEQ ID NO: 3025), Hexon Assembly (22K) (SEQ ID NO: 3026), and Hexon-associated precursor (SEQ ID NO: 3027); and Ad2 Region E4 (SEQ ID NO: 3030) encoding E4 ORF1 (SEQ ID NO: 3032), E4 ORF2 (SEQ ID NO: 3033), E4 ORF3 (SEQ ID NO: 3034), E4 ORF4 (SEQ ID NO: 3035), E4 ORF6 (SEQ ID NO: 3036), and/or E4 ORF6/7 (SEQ ID NO: 3037).

pHELP_KanV4 comprises: the Ad2 Region VA-RNA (SEQ ID NO: 3010) containing VA-RNA region (VA RNA I) (SEQ ID NO: 3011) and/or VA-RNA region (VA RNA II) (SEQ ID NO: 3012); Ad2 Region E2 (SEQ ID NO: 3020) encoding 23K endoprotease (C-terminal fragment) (SEQ ID NO: 3022), E2A/DBP (SEQ ID NO: 3023), Hexon Assembly (100K) (SEQ ID NO: 3024), Hexon Assembly (33K) (SEQ ID NO: 3025), Hexon Assembly (22K) (SEQ ID NO: 3026), and Hexon-associated precursor (SEQ ID NO: 3027); and Ad2 Region E4 (SEQ ID NO: 3030) encoding E4 ORF1 (SEQ ID NO: 3032), E4 ORF2 (SEQ ID NO: 3033), E4 ORF3 (SEQ ID NO: 3034), E4 ORF4 (SEQ ID NO: 3035), E4 ORF6 (SEQ ID NO: 3036), and/or E4 ORF6/7 (SEQ ID NO: 3037).

In further embodiments, any of the helper virus genes such as any of the adenoviral helper genes may be provided by a packaging cell engineered to express any of such genes.

It is a specific object of the invention to provide a recombinant AAV (rAAV) vector comprising or consisting of: (I) an AAV capsid; and (II) a rAAV vector genome according to any of the rAAV vector genomes described above.

In some instances, the AAV capsid may be an AAV1, AAV2, AAV3, AAV4, AAV5, AAV6, AAV7, AAV8, AAV9, or AAVrh.10 capsid, preferably an AAV2, AAV9, or AAVrh.10 capsid, or a variant thereof.

In some instances, the AAV capsid may comprise or consist of the amino acid sequence of SEQ ID NO: 731 or an amino acid sequence having at least 95%, 96%, 97%, 98%, or 99% identity thereto.

In some instances, the AAV capsid may comprise or consist of the amino acid sequence of SEQ ID NO: 732 or an amino acid sequence having at least 95%, 96%, 97%, 98%, or 99% identity thereto.

In some instances, the AAV capsid may comprise or consist of the amino acid sequence of SEQ ID NO: 733 or an amino acid sequence having at least 95%, 96%, 97%, 98%, or 99% identity thereto.

In certain instances, the rAAV vector (i.e., the rAAV viral particle) may comprise an AAV9 VP1 capsid protein, an AAV9 VP2 capsid protein, and an AAV9 VP3 capsid protein. In some specific instances, the rAAV vector may comprise: (a) an AAV9 VP1 capsid protein comprising the amino acid sequence of SEQ ID NO: 731 or an amino acid sequence having at least 95%, 96%, 97%, 98%, or 99% identity thereto; (b) an AAV9 VP2 capsid protein comprising the amino acid sequence of SEQ ID NO: 732 or an amino acid sequence having at least 95%, 96%, 97%, 98%, or 99% identity thereto; and (c) an AAV9 VP3 capsid protein comprising the amino acid sequence of SEQ ID NO: 732 or an amino acid sequence having at least 95%, 96%, 97%, 98%, or 99% identity thereto.

In some instances, the AAV capsid may comprise or consist of the amino acid sequence of SEQ ID NO: 831 or an amino acid sequence having at least 95%, 96%, 97%, 98%, or 99% identity thereto.

In some instances, the AAV capsid may comprise or consist of the amino acid sequence of SEQ ID NO: 832 or an amino acid sequence having at least 95%, 96%, 97%, 98%, or 99% identity thereto.

In some instances, the AAV capsid may comprise or consist of the amino acid sequence of SEQ ID NO: 833 or an amino acid sequence having at least 95%, 96%, 97%, 98%, or 99% identity thereto.

In certain instances, the rAAV vector (i.e., the rAAV viral particle) may comprise an AAV2 VP1 capsid protein, an AAV2 VP2 capsid protein, and an AAV2 VP3 capsid protein. In some specific instances, the rAAV vector may comprise: (a) an AAV2 VP1 capsid protein comprising the amino acid sequence of SEQ ID NO: 831 or an amino acid sequence having at least 95%, 96%, 97%, 98%, or 99% identity thereto; (b) an AAV2 VP2 capsid protein comprising the amino acid sequence of SEQ ID NO: 832 or an amino acid sequence having at least 95%, 96%, 97%, 98%, or 99% identity thereto; and (c) an AAV2 VP3 capsid protein comprising the amino acid sequence of SEQ ID NO: 832 or an amino acid sequence having at least 95%, 96%, 97%, 98%, or 99% identity thereto.

In some instances, the AAV capsid may comprise or consist of the amino acid sequence of SEQ ID NO: 931 or an amino acid sequence having at least 95%, 96%, 97%, 98%, or 99% identity thereto.

In some instances, the AAV capsid may comprise or consist of the amino acid sequence of SEQ ID NO: 932 or an amino acid sequence having at least 95%, 96%, 97%, 98%, or 99% identity thereto.

In some instances, the AAV capsid may comprise or consist of the amino acid sequence of SEQ ID NO: 933 or an amino acid sequence having at least 95%, 96%, 97%, 98%, or 99% identity thereto.

In certain instances, the rAAV vector (i.e., the rAAV viral particle) may comprise an AAVrh.10 VP1 capsid protein, an AAVrh10 VP2 capsid protein, and an AAVrh.10 VP3 capsid protein. In some specific instances, the rAAV vector may comprise: (a) an AAVrh.10 VP1 capsid protein comprising the amino acid sequence of SEQ ID NO: 931 or an amino acid sequence having at least 95%, 96%, 97%, 98%, or 99% identity thereto; (b) an AAVrh.10 VP2 capsid protein comprising the amino acid sequence of SEQ ID NO: 932 or an amino acid sequence having at least 95%, 96%, 97%, 98%, or 99% identity thereto; and (c) an AAVrh.10 VP3 capsid protein comprising the amino acid sequence of SEQ ID NO: 932 or an amino acid sequence having at least 95%, 96%, 97%, 98%, or 99% identity thereto.

It is also a specific object of the invention to provide a composition suitable for in vivo administration which comprises: (A) a prophylactically or therapeutically effective amount of any of the rAAV vector described herein; and (B) a pharmaceutically acceptable carrier.

In some instances, the composition may comprise a dose of the rAAV vector of between about $1 \times 10^{13}$ genome copies (GC) and about $1 \times 10^{15}$ GC.

It is also a specific object of the invention to provide several compositions, each composition according the composition described above, which in the aggregate may comprise a total dose of the rAAV vector of between about $1 \times 10^{13}$ GC and about $1 \times 10^{15}$ GC.

In some instances, in any of the composition or compositions as described above, the dose of the rAAV vector may be comprised in a volume of between about 10 mL and about 150 mL.

In some instances, in any of the composition or compositions as described above, the dose of the rAAV vector may be comprised in a volume of about 10 mL, about 20 mL, about 30 mL, about 40 mL, about 50 mL, about 60 mL, about 70 mL, about 80 mL, about 90 mL, about 100 mL, about 110 mL, about 120 mL, about 130 mL, about 140 mL, or about 150 mL.

In some instances, any of the composition or compositions as described above may be suitable for intrathecal, intracerebroventricular (ICV), intrathecal-lumbar (IT-L), intravascular, intramuscular, or intracisternal administration.

In some instances, any of the composition or compositions as described above may be suitable for intrathecal administration.

In some instances, any of the composition or compositions as described above may be suitable for intrathecal administration by a pump. It is another specific object of the invention to provide methods of treating and/or preventing ALD or AMN in subjects and/or ameliorating symptoms associated with ALD and/or AMN in need thereof comprising administering to a subject in need thereof a prophylactically or therapeutically effective amount of at least one of any polynucleotides as described above, at least one of any rAAV vectors as described above, and/or at least one or more of any of the compositions as described above.

In some instances, the subject is human.

In some instances, the method alleviates, reduces or stabilizes one or more symptoms in the subject such as the accumulation of high levels of saturated, very long chain fatty acids (VLCFA) in plasma and tissues of the brain, spinal cord, and adrenal cortex, adrenomyeloneuropathy (AMN), or peripheral neuropathy due to affected dorsal root ganglia neurons.

In some instances, the isolated polynucleotide, rAAV vector, or composition or compositions is/are delivered by intrathecal, intracerebroventricular (ICV), intrathecal-lumbar (IT-L), intravascular, intramuscular, or intracisternal administration.

In some instances, the delivery is by intrathecal administration.

In some instances, the intrathecal administration is mediated by a pump.

In some instances, when a rAAV vector or a composition comprising a rAAV is administered, the total administered dose of the rAAV vector may be about $1 \times 10^{13}$ GC to about $1 \times 10^{15}$ GC.

In some instances, the isolated polynucleotide, rAAV vector, or composition or compositions may be administered in a volume of between about 10 mL and about 150 mL.

In some instances, the isolated polynucleotide, rAAV vector, or composition or compositions may be administered in a volume of about 10 mL, about 20 mL, about 30 mL, about 40 mL, about 50 mL, about 60 mL, about 70 mL, about 80 mL, about 90 mL, about 100 mL, about 110 mL, about 120 mL, about 130 mL, about 140 mL, or about 150 mL, preferably about 100 mL.

In some instances, the isolated polynucleotide, rAAV vector, or composition or compositions may be delivered in a single dose or multiple doses.

In some instances, the rAAV vector may comprise an AAV9, AAV2, or AAVrh.10 capsid.

It is another specific object of the invention to provide a method of making a viral vector.

In some instances, the method may comprise introducing any of the isolated polynucleotides described above in a packaging host cell. Optionally, the viral vector to which the vector genome contained in the polynucleotide may be packaged may be a rAAV vector comprising an AAV2, AAV9, or AAVrh.10 capsid.

In some instances, the method may comprise culturing a packaging cell comprising any of the rAAV vector genomes as described above. Optionally, the viral vector may be a rAAV vector comprising an AAV2, AAV9, or AAVrh.10 capsid. Further optionally, the packaging cell may comprise a polynucleotide encoding an AAV cap and/or an AAV rep.

It is another specific object of the invention to provide a cell comprising any of the rAAV vector genome as described above. Such a cell may be useful for producing any of the rAAV vectors described herein. Optionally, the cell comprises a polynucleotide encoding an AAV cap and/or an AAV rep. Alternatively, when the cell does not comprise a polynucleotide encoding an AAV cap and/or an AAV rep, a polynucleotide encoding an AAV cap and/or an AAV rep may be introduced to the cell during production of any of the rAAV vectors described herein.

It is also an object of the invention to provide an AAV 5' ITR variant and/or AAV 3' ITR variant, which comprise(s) a shortened A region sequence. When such an AAV 5' ITR and/or an AAV 3' ITR variant are flanking an expression cassette comprising a gene of interest (GOI) in an AAV genome, such an AAV 5' ITR and/or an AAV 3' ITR variant may be useful for enhancing the expression of the (GOI).

In some instances, the AAV 5' ITR variant may comprise or consists of the nucleic acid sequence of SEQ ID NO: 2, 10501, 11001, 11101, 11201, 11301, 11501, or 11701.

In some instances, the AAV 3' ITR variant may comprise or consists of the nucleic acid sequence of SEQ ID NO: 28, 10518, 11018, 11118, 11218, 11318, 11518, or 11718.

It is further an object of the invention to provide an isolated polynucleotide comprising a rAAV vector genome, comprising or consisting: (a) any of the AAV 5' ITR variants comprising a shortened A region sequence as described above; (b) an expression cassette, comprising at least (i) a promoter active in target cells, operably linked to (ii) a polynucleotide encoding gene of interest (GOI), and (iii) one or more poly A signal downstream of said GOI-encoding polynucleotide; and (c) any of the AAV 3' ITR variants comprising a shortened A region sequence as described above.

In some instances, the polynucleotide may be is a plasmid, optionally comprising a pUC57 or pUC118 backbone.

It is yet an object of the invention to provide a composition comprising: (A) an isolated polynucleotide comprising a rAAV vector genome, comprising or consisting: (A-a) any of the AAV 5' ITR variants comprising a shortened A region sequence as described above; (A-b) an expression cassette, comprising at least (i) a promoter active in target cells, operably linked to (ii) a polynucleotide encoding gene of interest (GOI), and (iii) one or more poly A signal downstream of said GOI-encoding polynucleotide; and (A-c) any of the AAV 3' ITR variants comprising a shortened A region sequence as described above.

In some instances, the composition may further comprise any one or more of:
(B) a transfection reagent; (C) a polynucleotide which comprises an AAV capsid (cap) gene; (D) a polynucleotide which comprises an AAV replication (rep) gene; (E) a cell comprising a polynucleotide which comprises an AAV cap gene; (F) a cell comprising a polynucleotide which comprises an AAV rep gene; and/or (G) a pharmaceutically acceptable carrier or excipient.

In certain instances, in the AAV vector genome contained in the polynucleotide, (i) the AAV cap gene may be derived from the cap gene of AAV1, AAV2, AAV3, AAV4, AAV5, AAV6, AAV7, AAV8, AAV9, and AAVrh.10, preferably of AAV2, AAV9, or AAVrh.10; and/or (ii) the AAV rep gene may be derived from the rep gene of AAV1, AAV2, AAV3, AAV4, AAV5, AAV6, AAV7, AAV8, AAV9, and AAVrh.10, preferably of AAV2, AAV9, or AAVrh.10.

It is also an object of the invention to provide a cell comprising any of the isolated polynucleotide comprising a rAAV vector genome which comprises or consists of: (a) any of the AAV 5' ITR variants comprising a shortened A region sequence as described above; (b) an expression cassette, comprising at least (i) a promoter active in target cells, operably linked to (ii) a polynucleotide encoding gene of interest (GOI), and (iii) one or more poly A signal downstream of said GOI-encoding polynucleotide; and (c) any of the AAV 3' ITR variants comprising a shortened A region sequence as described above.

In some instances, the cell may further comprise a polynucleotide encoding an AAV cap and/or an AAV rep.

It is also an object of the invention to provide a rAAV vector comprising or consisting of: (I) an AAV capsid; and (II) a rAAV vector genome according to the rAAV vector genome which comprises or consists of: (a) any of the AAV 5' ITR variants comprising a shortened A region sequence as described above; (b) an expression cassette, comprising at least (i) a promoter active in target cells, operably linked to (ii) a polynucleotide encoding gene of interest (GOI), and (iii) one or more poly A signal downstream of said GOI-encoding polynucleotide; and (c) any of the AAV 3' ITR variants comprising a shortened A region sequence as described above.

In some instances, the AAV capsid is an AAV1, AAV2, AAV3, AAV4, AAV5, AAV6, AAV7, AAV8, AAV9, or AAVrh.10 capsid, preferably an AAV2, AAV9, or AAVrh.10 capsid, or a variant thereof.

It is also an object of the invention to provide a composition or compositions suitable for in vivo administration which comprises a prophylactically or therapeutically effective amount of the rAAV vector comprising or consisting of:

(I) an AAV capsid; and (II) a rAAV vector genome according to the rAAV vector genome which comprises or consists of: (II-a) any of the AAV 5' ITR variants comprising a shortened A region sequence as described above; (II-b) an expression cassette, comprising at least (i) a promoter active in target cells, operably linked to (ii) a polynucleotide encoding gene of interest (GOI), and (iii) one or more poly A signal downstream of said GOI-encoding polynucleotide; and (II-c) any of the AAV 3' ITR variants comprising a shortened A region sequence as described above.

In some instances, the composition or compositions may further comprise a pharmaceutically acceptable carrier.

It is also an object of the invention to provide a method of gene therapy in a subject in need thereof comprising administering to a subject in need thereof a prophylactically or therapeutically effective amount of: (A) at least one rAAV vector comprising or consisting of (I) an AAV capsid and (II) a rAAV vector genome according to the rAAV vector genome which comprises or consists of (II-a) any of the AAV 5' ITR variants comprising a shortened A region sequence as described above, (II-b) an expression cassette, comprising at least (i) a promoter active in target cells, operably linked to (ii) a polynucleotide encoding gene of interest (GOI), and (iii) one or more poly A signal downstream of said GOI-encoding polynucleotide, and (II-c) any of the AAV 3' ITR variants comprising a shortened A region sequence as described above; or (B) composition or compositions comprising such a rAAV vector.

It is also an object of the invention to provide a method of making a viral vector, comprising introducing into a packaging cell the isolated polynucleotide comprising a rAAV vector genome which comprises or consists of: (a) any of the AAV 5' ITR variants comprising a shortened A region sequence as described above; (b) an expression cassette, comprising at least (i) a promoter active in target cells, operably linked to (ii) a polynucleotide encoding gene of interest (GOI), and (iii) one or more poly A signal downstream of said GOI-encoding polynucleotide; and (c) any of the AAV 3' ITR variants comprising a shortened A region sequence as described above.

In some instances, the viral vector is a rAAV vector comprising an AAV2, AAV9, or AAVrh.10 capsid.

It is yet an object of the invention to provide a method of making a viral vector, comprising culturing a packaging cell comprising a rAAV vector genome which comprises or consists of: (a) any of the AAV 5' ITR variants comprising a shortened A region sequence as described above; (b) an expression cassette, comprising at least (i) a promoter active in target cells, operably linked to (ii) a polynucleotide encoding gene of interest (GOI), and (iii) one or more poly A signal downstream of said GOI-encoding polynucleotide; and (c) any of the AAV 3' ITR variants comprising a shortened A region sequence as described above.

In some instances, the viral vector is a rAAV vector comprising an AAV2, AAV9, or AAVrh.10 capsid.

In certain instances, the packaging cell comprises a polynucleotide encoding an AAV cap and/or an AAV rep.

In some embodiments such improved AAV-ABCD1 constructs will comprise an ABCD1 coding sequence modified to contain fewer alternative open reading frames relative to the ABCD1 coding sequence contained in SEQ ID NO: 200 or will not contain any alternative open reading frames. Alternatively, or in addition, the ABCD1 coding sequence may be modified to remove internal Kozak or Kozak-like sequences, preferably by the introduction of mutations that are silent with respect to the ABCD1 coding sequence. Alternatively or in addition, the ABCD1 coding sequence will be modified, preferably by the introduction of silent mutations, to remove one or more of: (i) TATA-boxes (ii) chi-sites, (iii) ribosomal entry sites, (iv) ARE sequence elements, (v) INS sequence elements, (vi) CRS sequence elements and/or (vii) cryptic splice donor and acceptor sites. Such modifications are expected to avoid any potential to express non-self-antigens and/or improve expression of ABCD1.

In some embodiments such improved AAV-ABCD1 constructs will comprise a Kozak sequence, such as 'CCACC' or 'GCCACC', or any sequence representing an approach to the consensus sequence for optimal protein translation initiation: 'GCCRCC<u>ATG</u>G)' upstream of the ABCD1 start site.

In some embodiments such improved AAV-ABCD1 constructs will only comprise a single polyA site downstream of the ABCD1 gene (such as SV40 polyA sequence and/or a BGH polyA sequence, or other suitable polyA sequence including synthetic polyA) to reduce the size of the ABCD1 transgene cassette.

In some embodiments such improved AAV-ABCD1 constructs may comprise multiple polyA sites downstream of the ABCD1 gene (such as SV40 polyA sequence and a BGH polyA sequence, or other suitable polyA sequence including synthetic polyA).

In some embodiments such improved AAV-ABCD1 constructs will comprise an shortened or truncated AAV 3' ITR.

In some embodiments such improved AAV-ABCD1 constructs will be comprised on a pUC57 or pUC118 backbone.

In other embodiments such improved AAV-ABCD1 constructs will comprise a human ABCD1 coding sequence which is predominantly (over 50, 60, 70, 80, 90 or 95%) or entirely of comprised of human preferred codons.

In other embodiments such improved AAV-ABCD1 constructs will comprise a human ABCD1 coding sequence selected from those of SEQ ID NO: 204, SEQ ID NO: 304, SEQ ID NO: 404, SEQ ID NO: 501-510, SEQ ID NO: 14, and SEQ ID NOS: 10012, 10112, 10212, 10512, 11012, 11112, 11212, 11312, 11512, and 11712.

In some embodiments, such improved AAV-ABCD1 constructs may comprise or be derived from pSBT101.

In some embodiments, such improved AAV-ABCD1 constructs (AAV vectors, AAV vector genomes, or vector genome-encoding polynucleotides) may comprise or be derived from pOB1005, pOB1010, pOB1011, pOB1012, pOB1013, pOB1015, or pOB1017.

In some preferred embodiments, such improved AAV-ABCD1 constructs may comprise or be derived from pSBT101, pOB1010, pOB1015, or pOB1017.

In some preferred embodiments, such improved AAV-ABCD1 vector genome may be the vector genome encoded in the plasmid pSBT101, pOB1010, pOB1015, or pOB1017.

In some preferred embodiments, such improved AAV-ABCD1 vector genome-encoding polynucleotides may comprise or be derived from pSBT101, pOB1010, pOB1015, or pOB1017.

In some preferred embodiments, such improved AAV-ABCD1 vector genome may be produced from pSBT101, pOB1010, pOB1015, or pOB1017.

In some preferred embodiments, such improved AAV-ABCD1 vector genome may be the vector genome of SBT101, OB1010, OB1015, or OB1017.

In other embodiments such improved AAV-ABCD1 constructs (AAV vectors, AAV vector genomes, or vector genome-encoding polynucleotides) may comprise or be derived from the genome of AAV-CBA-ABCD1-WPRE (Xinact), e.g., the AAV-ABCD1 vector genome may comprise or consist of the nucleic acid sequence of SEQ ID NO: 10050 or 10060.

In other embodiments, such improved AAV-ABCD1 constructs (AAV vectors, AAV vector genomes, or vector genome-encoding polynucleotides) may comprise or be derived from the genome of AAV-CBA-ABCD1 [no WPRE], e.g., such vector genome may comprise or consist of the nucleic acid sequence of SEQ ID NO: 10250 or 10260.

In other embodiments, such improved AAV-ABCD1 constructs (AAV vectors, AAV vector genomes, or vector genome-encoding polynucleotides) may comprise or be derived from pSBT101, e.g., the AAV-ABCD1 vector genome may comprise or consist of the nucleic acid sequence of SEQ ID NO: 10150 or 10160.

In other embodiments, such improved AAV-ABCD1 constructs (AAV vectors, AAV vector genomes, or vector genome-encoding polynucleotides) may comprise or be derived from pOB1005, e.g., the AAV-ABCD1 vector genome may comprise or consist of the nucleic acid sequence of SEQ ID NOS: 10550 or 10560 or nucleotides 1-3713 inclusive of pOB1005 (SEQ ID NO: 100).

In other embodiments, such improved AAV-ABCD1 constructs (AAV vectors, AAV vector genomes, or vector genome-encoding polynucleotides) may comprise or be derived from pOB1010, e.g., the AAV-ABCD1 vector genome may comprise or consist of the nucleic acid sequence of SEQ ID NO: 11050 or 11060.

In other embodiments, such improved AAV-ABCD1 constructs (AAV vectors, AAV vector genomes, or vector genome-encoding polynucleotides) may comprise or be derived from pOB1011, e.g., the AAV-ABCD1 vector genome may comprise or consist of the nucleic acid sequence of SEQ ID NO: 11150 or 11160.

In other embodiments, such improved AAV-ABCD1 constructs (AAV vectors, AAV vector genomes, or vector genome-encoding polynucleotides) may comprise or be derived from pOB1012, e.g., the AAV-ABCD1 vector genome may comprise or consist of the nucleic acid sequence of SEQ ID NO: 11250 or 11260.

In other embodiments, such improved AAV-ABCD1 constructs (AAV vectors, AAV vector genomes, or vector genome-encoding polynucleotides) may comprise or be derived from pOB1013, e.g., the AAV-ABCD1 vector genome may comprise or consist of the nucleic acid sequence of SEQ ID NO: 11350 or 11360.

In other embodiments, such improved AAV-ABCD1 constructs (AAV vectors, AAV vector genomes, or vector genome-encoding polynucleotides) may comprise or be derived from pOB1015, e.g., the AAV-ABCD1 vector genome may comprise or consist of the nucleic acid sequence of SEQ ID NO: 11550 or 11560.

In other embodiments, such improved AAV-ABCD1 constructs (AAV vectors, AAV vector genomes, or vector genome-encoding polynucleotides) may comprise or be derived from pOB1017, e.g., the AAV-ABCD1 vector genome may comprise or consist of the nucleic acid sequence of SEQ ID NO: 11750 or 11760.

In some embodiments such improved AAV-ABCD1 constructs will only comprise a single polyA site downstream of the ABCD1 gene (such as SV40 polyA sequence and/or a BGH polyA sequence, or other suitable polyA sequence including synthetic polyA) to reduce the size of the ABCD1 transgene cassette.

In some embodiments such improved AAV-ABCD1 constructs may comprise multiple polyA sites downstream of the ABCD1 gene (such as SV40 polyA sequence and a BGH polyA sequence, or other suitable polyA sequence including synthetic polyA).

In some embodiments such improved AAV-ABCD1 constructs will comprise a shortened or truncated AAV 3' ITR.

In specific embodiments the improved AAV-ABCD1 construct may comprise (i) 5' and 3' AAV ITR sequences from any AAV serotype, e.g., AAV2, AAV9, or AAVrh.10 ITR sequences which ITR sequences may flank the following sequences (ii) a promoter operable in cells of the central nervous system (such as neurons or glial cells) such as a hybrid promoter, which, for example, comprises a CMV immediate early enhancer (also referred to herein as CMV enhancer) upstream of a chicken beta actin promoter, beta actin exon, a chimeric intron, and a rabbit beta-globin exon, which is upstream of (iii) a human ABCD1 coding sequence which ABCD1 coding sequence optionally may be modified e.g., to remove start or stop codons, to be comprised of human preferred codons and/or by the addition of a KOZAK sequence, such as 'CCACC', at the 5' end thereof and/or may comprise a human ABCD1 coding sequence selected from those of SEQ ID NO: 204, SEQ ID NO: 304, SEQ ID NO: 404, SEQ ID NO: 501-510, SEQ ID NO: 14, and SEQ ID NOS: 10012, 10112, 10212, 10512, 11012, 11112, 11212, 11312, 11512, and 11712, (iv) optionally a modified WPRE sequence which WPRE if present is modified to eliminate X protein expression or is mutated such that it encodes an inactive form of the X protein and (v) at least one polyA sequence downstream of the ABCD1 coding sequence and modified WPRE sequence if present such as a SV40 polyA sequence and/or a BGH polyA sequence, or other suitable polyA sequence including synthetic polyA.

In specific embodiments the improved AAV-ABCD1 construct may comprise pOB1005 (SEQ ID NO: 100 or 10500) or nucleotides 1-3713 inclusive of pOB1005, AAV-CBA-hABCD1-WPREXinact (SEQ ID NO: 300 or 10000) or AAV-CBA-hABCD1 (SEQ ID NO: 400 or 10200), pSBT101 (SEQ ID NO: 10100), pOB1010 (SEQ ID NO: 11000), pOB1011 (SEQ ID NO: 11100), pOB1012 (SEQ ID NO: 11200), pOB1013 (SEQ ID NO: 11300), pOB1015 (SEQ ID NO: 11500), or pOB1017 (SEQ ID NO: 11700), or may comprise a variant of any of the foregoing which is modified e.g., to comprise a human ABCD1 coding sequence selected from those of SEQ ID NO: 204, SEQ ID NO: 304, SEQ ID NO: 404, SEQ ID NO: 501-510, SEQ ID NO: 14, and SEQ ID NOS: 10012, 10112, 10212, 10512, 11012, 11112, 11212, 11312, 11512, and 11712, or the promoter used to regulate ABCD1 expression is substituted with another promoter operable in cells of the central nervous system (such as neurons or glial cells) e.g., one selected from those afore-mentioned or the WPRE is eliminated or a different mutated WPRE may be inserted which is mutated to eliminate X protein expression or is modified to express an inactive (e.g., truncated or otherwise modified inactive X protein) such as the modified WPRE in SEQ ID NO: 305 or 10075 or is modified by the insertion of a KOZAK sequence, such as 'CCACC', or any sequence representing an approach to the consensus sequence for optimal protein translation initiation: 'GCCRCCATGG)' before the ABCD1 coding sequence or is modified by the replacement of the polyA signal sequences contained in any of the foregoing constructs with another polyA sequence or by the replacement of the AAV2 ITR sequences with ITR sequences derived from other AAV's and the like and combinations of any of the foregoing.

In one embodiment, the nucleic acid sequence encoding human ABCD1 in the construct may further comprise a nucleic acid encoding a tag polypeptide covalently linked thereto. The tag polypeptide may be selected from known "epitope tags" including, without limitation, a myc tag polypeptide, a glutathione-S— transferase tag polypeptide, a green fluorescent protein tag polypeptide, a His6 tag polypeptide, an influenza virus hemagglutinin tag polypeptide, a flag tag polypeptide, and a maltose binding protein tag polypeptide.

In another aspect, an expression cassette comprising a nucleic acid sequence that encodes human ABCD1 is provided. In one embodiment, the sequence is a codon or otherwise optimized sequence as afore-described.

In another embodiment, an expression cassette for use in an AAV vector is provided. In that embodiment, the AAV expression cassette includes at least one AAV inverted terminal repeat (ITR) sequence. In another embodiment, the expression cassette comprises 5' ITR sequences and 3' ITR sequences. In one embodiment, the 5' and 3' ITRs flank the nucleic acid sequence that encodes human ABCD1 and optionally a modified WPRE, optionally with additional sequences which direct expression of the sequence that encodes human ABCD1 in a host cell. Thus, as described herein, an AAV expression cassette is meant to describe an expression cassette as described above flanked on its 5' end by a 5'AAV inverted terminal repeat sequence (ITR) and on its 3' end by a 3' AAV ITR. Thus, this rAAV genome contains the minimal sequences required to package the expression cassette into an AAV viral particle, i.e., the AAV 5' and 3' ITRs. The AAV ITRs may be obtained from the ITR sequences of any AAV, such as described herein. These ITRs may be of the same AAV origin as the capsid employed in the resulting recombinant AAV, or of a different AAV origin (to produce an AAV pseudotype). In one embodiment, the ITR sequences from AAV2, AAV9, or AAVrh.10, or the deleted, shortened, or truncated version thereof are used for convenience and to accelerate regulatory approval. However, ITRs from other AAV sources may be selected. Where the source of the ITRs is from AAV2 and the AAV capsid is from another AAV source, the resulting vector may be termed pseudotyped. Typically, the AAV vector genome comprises an AAV 5' ITR, the human ABCD1 coding sequences and suitable regulatory sequences, and an AAV 3' ITR. However, other configurations of these elements may be suitable. Each rAAV genome can be then introduced into a production plasmid. Exemplary shortened 5' ITR sequences include, but are not limited to, the nucleic acid sequence of SEQ ID NOS: 10501, 11001, 11101, 11201, 11301, 11501, and 11701. Exemplary shortened 3' ITR sequences include, but are not limited to, the nucleic acid sequence of SEQ ID NOS: 10518, 11018, 11118, 11218, 11318, 11518, and 11718.

In one aspect, a vector comprising any of the expression cassettes described herein is provided. As described herein, such vectors can be plasmids of variety of origins and are useful in certain embodiments for the generation of recombinant replication defective viruses as described further herein.

In another embodiment, the vector is a viral vector that comprises an expression cassette described therein. In one embodiment, an expression cassette as described herein may be engineered onto a plasmid which is used for drug delivery or for production of a viral vector. Suitable viral vectors are preferably replication defective and selected from amongst those which target brain cells. Viral vectors may include any virus suitable for gene therapy, including but not limited to adenovirus; herpes virus; lentivirus; retrovirus; parvovirus, etc. However, herein an adeno-associated virus is the embodied virus vector. The viral vectors, or non-viral vectors, can be formulated with a physiologically acceptable carrier for use in gene transfer and gene therapy applications.

In another embodiment, a recombinant adeno-associated virus (rAAV) vector is provided. The rAAV compromises an AAV capsid, and a vector genome packaged therein.

The vector genome comprises, in one embodiment: (a) an AAV 5' inverted terminal repeat (ITR) sequence; (b) a promoter; (c) a coding sequence encoding a human ABCD1; and (d) an AAV 3' ITR.

Adeno-associated virus (AAV), a member of the Parvovirus family, is a small nonenveloped, icosahedral virus with single-stranded linear DNA genomes of 4.7 kilobases (kb) to 5 kb. Among known AAV serotypes are AAV1, AAV2, AAV3, AAV4, AAV5, AAV6, AAV7, AAV8, AAV9, AAVrh.10, and others. The ITRs or other AAV components may be readily isolated or engineered using techniques available to those of skill in the art from an AAV. Such AAV may be isolated, engineered, or obtained from academic, commercial, or public sources (e.g., the American Type Culture Collection, Manassas, VA). Alternatively, the AAV sequences may be engineered through synthetic or other suitable means by reference to published sequences such as are available in the literature or in databases such as, e.g., GenBank, PubMed, or the like. AAV viruses may be engineered by conventional molecular biology techniques, making it possible to optimize these particles for cell specific delivery of nucleic acid sequences, for minimizing immunogenicity, for tuning stability and particle lifetime, for efficient degradation, for accurate delivery to the nucleus, etc.

Fragments of AAV may be readily utilized in a variety of vector systems and host cells. Among desirable AAV fragments are the cap proteins, including the vp1, vp2, vp3 and hypervariable regions, the rep proteins, including rep 78, rep 68, rep 52, and rep 40, and the sequences encoding these proteins. Such fragments may be used alone, in combination with other AAV serotype sequences or fragments, or in combination with elements from other AAV or non-AAV viral sequences. As used herein, artificial AAV serotypes include, without limitation, AAV with a non-naturally occurring capsid protein. Such an artificial capsid may be generated by any suitable technique, using a novel AAV sequence of the invention (e.g., a fragment of a vp1 capsid protein) in combination with heterologous sequences which may be obtained from another AAV serotype (known or novel), non-contiguous portions of the same AAV serotype, from a non-AAV viral source, or from a non-viral source. An artificial AAV serotype may be, without limitation, a chimeric AAV capsid, a recombinant AAV capsid, or a "humanized" AAV capsid. In one embodiment, a vector contains AAV9 cap and/or rep sequences. See, U.S. Pat. No. 7,906, 111, which is incorporated by reference herein.

In one embodiment, the AAV vector may comprise an AAV9 capsid. As used herein, an "AAV9 capsid" is characterized by DNAse-resistant particle which is an assembly of about 60 viral proteins (vp) which are typically expressed as alternative splice variants resulting in proteins of different length. See also Genbank Accession No. AAS99264.1, which is incorporated herein by reference. See, also U.S. Pat. No. 7,906,111 and WO 2005/033321. As used herein "AAV9 variants" include those described in, e.g., WO2016/ 049230, U.S. Pat. No. 8,927,514, US 2015/0344911, and U.S. Pat. No. 8,734,809, or a sequence sharing at least about 90%, 95%, 95%, 98% or 99% identity therewith.

An exemplary AAV9 capsid may comprise the amino acid sequence of SEQ ID NO: 731 (AAV9 VP1), SEQ ID NO: 732 (AAV9 VP2), or SEQ ID NO: 733 (AAV9 VP3) or an amino acid sequence having at least 95%, 96%, 97%, 98%, or 99% identity thereto. In some instances, the AAV vector may comprise one or more of an AAV9 VP1 capsid, an AAV9 VP2 capsid, and an AAV9 VP3 capsid.

In one embodiment, the AAV vector may comprise an AAV2 capsid.

An exemplary AAV2 capsid may comprise the amino acid sequence of SEQ ID NO: 831 (AAV2 VP1), SEQ ID NO: 832 (AAV2 VP2), or SEQ ID NO: 833 (AAV2 VP3) or an amino acid sequence having at least 95%, 96%, 97%, 98%, or 99% identity thereto. In some instances, the AAV vector may comprise one or more of an AAV2 VP1 capsid, an AAV2 VP2 capsid, and an AAV2 VP3 capsid.

In one embodiment, the AAV vector may comprise an AAVrh.10 capsid.

An exemplary AAVrh.10 capsid may comprise the amino acid sequence of SEQ ID NO: 931 (AAVrh.10 VP1), SEQ ID NO: 932 (AAVrh.10 VP2), or SEQ ID NO: 933 (AAVrh.10 VP3) or an amino acid sequence having at least 95%, 96%, 97%, 98%, or 99% identity thereto. In some instances, the AAV vector may comprise one or more of an AAVrh.10 VP1 capsid, an AAVrh.10 VP2 capsid, and an AAVrh.10 VP3 capsid.

As used herein, the term "clade" as it relates to groups of AAV refers to a group of AAV which are phylogenetically related to one another as determined using a Neighbor-Joining algorithm by a bootstrap value of at least 75% (of at least 1000 replicates) and a Poisson correction distance measurement of no more than 0.05, based on alignment of the AAV vp1 amino acid sequence. The Neighbor-Joining algorithm has been described in the literature. See, e.g., M. Nei and S. Kumar, Molecular Evolution and Phylogenetics, Oxford University Press, New York (2000). Computer programs are available that can be used to implement this algorithm. For example, the MEGA v2.1 program implements the modified Nei-Gojobori method. Using these techniques and computer programs, and the sequence of an AAV vp 1 capsid protein, one of skill in the art can readily determine whether a selected AAV is contained in one of the clades identified herein, in another clade, or is outside these clades. See, e.g., G Gao, et al, *J Virol,* 2004 June; 78(10): 6381-6388, which identifies Clades A, B, C, D, E and F, and provides nucleic acid sequences of novel AAV, GenBank Accession Numbers AY530553 to AY530629. See, also, WO 2005/033321. AAV9 is further characterized by being within Clade F. Other Clade F AAV include AAVhu31 and AAVhu32.

As used herein, relating to AAV, the term variant means any AAV sequence which is derived from a known AAV sequence, including those sharing at least 70%, at least 75%, at least 80%, at least 85%, at least 90%, at least 95%, at least 97%, at least 99% or greater sequence identity over the amino acid or nucleic acid sequence. In another embodiment, the AAV capsid includes variants which may include up to about 10% variation from any described or known AAV capsid sequence. That is, the AAV capsid shares about 90% identity to about 99.9% identity, about 95% to about 99% identity or about 97% to about 98% identity to an AAV capsid provided herein and/or known in the art. In one embodiment, the AAV capsid shares at least 95% identity with an AAV9 capsid. When determining the percent identity of an AAV capsid, the comparison may be made over any of the variable proteins (e.g., vp1, vp2, or vp3). In one embodiment, the AAV capsid shares at least 95% identity with the AAV9 over the vp1, vp2 or vp3.

As used herein, "artificial AAV" means, without limitation, an AAV with a non-naturally occurring capsid protein. Such an artificial capsid may be generated by any suitable technique, using a selected AAV sequence (e.g., a fragment of a vp1 capsid protein) in combination with heterologous sequences which may be obtained from a different selected AAV, non-contiguous portions of the same AAV, from a non-AAV viral source, or from a non-viral source. An artificial AAV may be, without limitation, a pseudotyped AAV, a chimeric AAV capsid, a recombinant AAV capsid, or a "humanized" AAV capsid. Pseudotyped vectors, wherein the capsid of one AAV is replaced with a heterologous capsid protein, are useful in the invention. In one embodiment, AAV2/9 and AAV2/rh.10 are exemplary pseudotyped vectors.

In another embodiment, a self-complementary AAV is used. "Self-complementary AAV" refers a plasmid or vector having an expression cassette in which a coding region carried by a recombinant AAV nucleic acid sequence has been designed to form an intra-molecular double-stranded DNA template. Upon infection, rather than waiting for cell mediated synthesis of the second strand, the two complementary halves of scAAV will associate to form one double stranded DNA (dsDNA) unit that is ready for immediate replication and transcription. See, e.g., D M McCarty et al, "Self-complementary recombinant adeno-associated virus (scAAV) vectors promote efficient transduction independently of DNA synthesis", *Gene Therapy*, (August 2001), Vol 8, Number 16, Pages 1248-1254. Self-complementary AAVs are described in, e.g., U.S. Pat. Nos. 6,596,535; 7,125,717; and 7,456,683, each of which is incorporated herein by reference in its entirety.

In still another embodiment, the expression cassette, including any of those described herein is employed to generate a recombinant AAV genome.

In one embodiment, the expression cassette described herein is engineered into a suitable genetic element (vector) useful for generating viral vectors and/or for delivery to a host cell, e.g., naked DNA, phage, transposon, cosmid, episome, etc., which transfers the human ABCD1 sequences carried thereon. The selected vector may be delivered by any suitable method, including transfection, electroporation, liposome delivery, membrane fusion techniques, high velocity DNA-coated pellets, viral infection and protoplast fusion. The methods used to make such constructs are known to those with skill in nucleic acid manipulation and include genetic engineering, recombinant engineering, and synthetic techniques. See, e.g., Sambrook et al, Molecular Cloning: A Laboratory Manual, Cold Spring Harbor Press, Cold Spring Harbor, NY.

For packaging an expression cassette or rAAV genome or production plasmid into virions, the ITRs are the only AAV components required in cis in the same construct as the expression cassette. In one embodiment, the coding sequences for the replication (rep) and/or capsid (cap) are removed from the AAV genome and supplied in trans or by a packaging cell line in order to generate the AAV vector.

Methods for generating and isolating AAV viral vectors suitable for delivery to a subject are known in the art. See, e.g., U.S. Pat. Nos. 7,790,449; 7,282,199; WO 2003/042397; WO 2005/033321, WO 2006/110689; and U.S. Pat. No. 7,588,772 B2. In a one system, a producer cell line is transiently transfected with a construct that encodes the transgene flanked by ITRs and a plasmid that encodes rep and cap. In a second system, a packaging cell line that stably supplies rep and cap is transiently transfected with a construct encoding the transgene flanked by ITRs. In each of these systems, AAV virions are produced in response to infection with helper adenovirus or herpesvirus, requiring the separation of the rAAVs from contaminating virus.

In one exemplary method for generating the AAV viral vector according to the present disclosure may comprise the following steps: (i) transfecting cells such as HEK293 cells with (1) a rAAV Genome Vector plasmid of interest (such as pSBT101, pOB1005, pOB1010, pOB1011, pOB1012, pOB1013, pOB1015, or pOB1017, or the plasmid encoding the AAV genome of AAV.ABCD1.WPRE-Xinact), (2) a plasmid encoding the AAV Rep and Cap protein ("Rep/Cap plasmid") (such as pAAV2/9) and (3) a plasmid that encodes one or more viral helper gene ("Virus helper plasmid") (such as pALD-X80 or pHELP_KanV4); (ii) performing purification such as column purification or CsCl gradient centrifugation on the supernatant or cell lysate; and (iii) desalting and concentrating the centrifugation product.

Alternatively, systems have been developed that do not require infection with helper virus to recover the AAV—the required helper functions (i.e., adenovirus E1, E2a, VA, and E4 or herpesvirus UL5, UL8, UL52, and UL29, and herpesvirus polymerase) are also supplied, in trans, by the system. In these newer systems, the helper functions can be supplied by transient transfection of the cells with constructs that encode the required helper functions, or the cells can be engineered to stably contain genes encoding the helper functions, the expression of which can be controlled at the transcriptional or posttranscriptional level.

In yet another system, the expression cassette flanked by ITRs and rep/cap genes are introduced into insect cells by infection with baculovirus-based vectors. For reviews on these production systems, see generally, e.g., Zhang et al, 2009, "Adenovirus-adeno-associated virus hybrid for large-scale recombinant adeno-associated virus production," *Human Gene Therapy* 20:922-929, the contents of which is incorporated herein by reference in its entirety. Methods of making and using these and other AAV production systems are also described in the following U.S. patents, the contents of each of which is incorporated herein by reference in its entirety: U.S. Pat. Nos. 5,139,941; 5,741,683; 6,057,152; 6,204,059; 6,268,213; 6,491,907; 6,660,514; 6,951,753; 7,094,604; 7,172,893; 7,201,898; 7,229,823; and 7,439,065. See generally, e.g., Grieger & Samulski, 2005, "Adeno-associated virus as a gene therapy vector: Vector development, production and clinical applications," *Adv. Biochem. Engin/Biotechnol.* 99: 119-145; Buning et al, 2008, "Recent developments in adeno-associated virus vector technology," *J. Gene Med.* 10:717-733; and the references cited below, each of which is incorporated herein by reference in its entirety.

The methods used to construct any embodiment of this invention are known to those with skill in nucleic acid manipulation and include genetic engineering, recombinant engineering, and synthetic techniques. See, e.g., Green and Sambrook et al, *Molecular Cloning: A Laboratory Manual*, Cold Spring Harbor Press, Cold Spring Harbor, NY (2012). Similarly, methods of generating rAAV virions are well known and the selection of a suitable method is not a limitation on the present invention. See, e.g., K. Fisher et al, (1993) *J. Virol.*, 70:520-532 and U.S. Pat. No. 5,478,745.

"Plasmids" generally are designated herein by a lower case p preceded and/or followed by capital letters and/or numbers, in accordance with standard naming conventions that are familiar to those of skill in the art. Many plasmids and other cloning and expression vectors that can be used in accordance with the present invention are well known and readily available to those of skill in the art. Moreover, those of skill readily may construct any number of other plasmids suitable for use in the invention. The properties, construction and use of such plasmids, as well as other vectors, in the present invention will be readily apparent to those of skill from the present disclosure.

In one embodiment, the production plasmid is that described herein, or as described in WO2012/158757, which is incorporated herein by reference. Various plasmids are known in the art for use in producing rAAV vectors and are useful herein. The production plasmids are cultured in the host cells which express the AAV cap and/or rep proteins. In the host cells, each rAAV genome is rescued and packaged into the capsid protein or envelope protein to form an infectious viral particle.

In one aspect, a production plasmid comprising an expression cassette described above is provided. In one embodiment, the production plasmid is one shown in FIGS. 5, 6, 7, 10-12. These plasmids are exemplified in the examples. Such plasmids contain a 5' AAV ITR sequence; a selected promoter; a polyA signal; and a 3' ITR; additionally, it also contains an intron sequence, such as the chicken beta-actin intron. An exemplary schematic thereof and associated SEQ ID NOs are shown in FIGS. 5, 6, 7, and 10-12. In some embodiments, the selected intron sequence keeps the rAAV vector genome with a size between about 3 kilobases (kb) to about 6 kb, about 4.7 kb to about 5 kb, about 3 kb to about 5.5 kb, or about 4.7 kb to 5.5 kb. An example of a production plasmid which includes the human ABCD1 encoding sequence can be found in SEQ ID NO: 100 or any of SEQ ID NOS: 10000, 10100, 10200, 10500, 11000, 11100, 11200, 11300, 11500, and 11700. In another embodiment, the production plasmid is modified to optimized vector plasmid production efficiency. Such modifications include addition of other neutral sequences, or inclusion of a lambda stuffer sequence to modulate the level of supercoil of the vector plasmid. Such modifications are contemplated herein. In other embodiments, terminator and other sequences are included in the plasmid.

In certain embodiments, the rAAV expression cassette, the vector (such as rAAV vector), the virus (such as rAAV), and/or the production plasmid comprises AAV inverted terminal repeat sequences, a codon optimized nucleic acid sequence that encodes human ABCD1, and expression control sequences that direct expression of the encoded proteins in a host cell. In other embodiments, the rAAV expression cassette, the virus, the vector (such as rAAV vector), and/or the production plasmid further comprise one or more of an intron, a Kozak sequence, a polyA, post-transcriptional regulatory elements and others. In one embodiment, the post-transcriptional regulatory element is a modified Woodchuck Hepatitis Virus (WHP) Posttranscriptional Regulatory Element (WPRE) wherein the X protein is not expressed or is expressed in an inactive form.

The expression cassettes, vectors and plasmids include other components that can be optimized for a specific species using techniques known in the art including, e.g., codon optimization, as described herein. The components of the cassettes, vectors, plasmids and viruses or other compositions described herein include a promoter sequence as part of the expression control sequences. In another embodiment, the promoter is cell-specific. The term "cell-specific" means that the particular promoter selected for the recombinant vector can direct expression of the human ABCD1 coding sequence in a particular cell or tissue type such as neurons or glial cells. In one embodiment, the promoter is specific for expression of the transgene in ependyma, the epithelial lining of the brain ventricular system. In another embodiment, the promoter is specific for expression in a brain cell selected from neurons, astrocytes, oligodendrocytes, dorsal root ganglia, and microglia. In one embodiment, the promoter is modified to add one or more restriction sites to facilitate cloning.

In another embodiment, the promoter is a ubiquitous or constitutive promoter. An example of a suitable promoter is a hybrid promoter, which in some instances comprises a chicken beta actin promoter along with a cytomegalovirus (CMV) enhancer element(s), such as the CMV enhancer sequence. Such a hybrid promoter is for example comprised in the constructs disclosed in FIGS. 5, 6, 7, and 10-12. In another embodiment, the promoter is the CB7 promoter. Other suitable promoters include the human b-actin promoter, the human elongation factor-1a promoter, the cytomegalovirus (CMV) promoter, the simian virus 40 promoter, and the herpes simplex virus thymidine kinase promoter. See, e.g., Damdindorj et al, (August 2014) "A Comparative Analysis of Constitutive Promoters Located in Adeno-Associated Viral Vectors", *PLOS ONE* 9(8): e106472. Still other suitable promoters include viral promoters, constitutive promoters, regulatable promoters [see, e.g., WO 2011/126808 and WO 2013/04943] Alternatively a promoter responsive to physiologic cues may be utilized in the expression cassette, rAAV genomes, vectors, plasmids and viruses described herein. In one embodiment, the promoter is of a small size, under 1000 bp, due to the size limitations of the AAV vector. In another embodiment, the promoter is under 400 bp. Other promoters may be selected by one of skill in the art.

In a further embodiment, the promoter is selected from SV40 promoter, the dihydrofolate reductase promoter, a phage lambda (PL) promoter, a herpes simplex viral (HSV) promoter, a tetracycline-controlled trans-activator-responsive promoter (tet) system, a long terminal repeat (LTR) promoter, such as a RSV LTR, MoMLV LTR, BIV LTR or an HIV LTR, a U3 region promoter of Moloney murine sarcoma virus, a Granzyme A promoter, a regulatory sequence(s) of the metallothionein gene, a CD34 promoter, a CD8 promoter, a thymidine kinase (TK) promoter, a B 19 parvovirus promoter, a PGK promoter, a glucocorticoid promoter, a heat shock protein (HSP) promoter, such as HSP65 and HSP70 promoters, an immunoglobulin promoter, an MMTV promoter, a Rous sarcoma virus (RSV) promoter, a lac promoter, a CaMV 35 S promoter, a nopaline synthetase promoter, an MND promoter, or an MNC promoter. The promoter sequences thereof are known to one of skill in the art or publicly available, such as in the literature or in databases, e.g., GenBank, PubMed, or the like.

In another embodiment, the promoter is an inducible promoter. The inducible promoter may be selected from known promoters including the rapamycin/rapalog promoter, the ecdysone promoter, the estrogen-responsive promoter, and the tetracycline-responsive promoter, or heterodimeric repressor switch. See, Sochor et al, "An Autogenously Regulated Expression System for Gene Therapeutic Ocular Applications", *Scientific Reports*, 2015 Nov. 24; 5: 17105 and Daber R, Lewis M., "A novel molecular switch", *J Mol Biol.* 2009 Aug. 28; 391(4):661-70, Epub 2009 Jun. 21 which are both incorporated herein by reference in their entirety.

In other embodiments, the expression cassette, vector, plasmid and virus described herein contain other appropriate transcription initiation, termination, enhancer sequences, efficient RNA processing signals such as splicing and polyadenylation (poly A) signals; TATA sequences; sequences that stabilize cytoplasmic mRNA; sequences that enhance translation efficiency (i.e., Kozak consensus sequence); introns; sequences that enhance protein stability; and when desired, sequences that enhance secretion of the encoded product. The expression cassette or vector may contain none, one or more of any of the elements described herein.

In some embodiments, the rAAV viral genome and plasmids encoding an rAAV viral genome as disclosed herein may comprise one terminator, which facilitate termination of translation of the encoded ABCD1 gene or an ABCD1 gene variant. In some instances, such a terminator may be referred to herein as "Terminator 1". In some embodiments, the rAAV viral genome and plasmids encoding an rAAV viral genome as disclosed herein may comprise another terminator, which also facilitate termination of translation of the encoded ABCD1 gene or an ABCD1 gene variant. In some instances, such a terminator may be referred to herein as "Terminator 2" and may be same as or different from "Terminator 1". In some embodiments, the rAAV viral genome and plasmids encoding an rAAV viral genome as disclosed herein may comprise more than two terminators. In some embodiments, Terminator 1 may be encoded by the nucleic acid sequence of SEQ ID NO: 10071, 10171, 10271, 10571, 11071, 11171, 11271, 11371, 11571, or 11771. In some embodiments, Terminator 2 may be encoded by the nucleic acid sequence of SEQ ID NO: 10572, 11272, or 11372.

Examples of suitable polyA (also referred to herein as "pA") signals include, e.g., a synthetic polyA or from bovine growth hormone (bGH), human growth hormone (hGH), SV40, rabbit b-globin (RGB), or modified RGB (mRGB). An exemplary bGH pA sequence may comprise the sequence provided by, e.g., Accession No. M57764. An exemplary hGH pA sequence may comprise the sequence provided by, e.g., Accession No. NG_011676. An exemplary SV40pA sequence may comprise the sequence provided by, e.g., Accession No. NC_001669. An exemplary RBG pA sequence may comprise the sequence provided by, e.g., Accession No. V00882. In an exemplary embodiment, the poly A is an SV40 or BGH polyA sequence comprising a nucleic acid sequence as shown in the AAV constructs described herein, such as those disclosed in FIGS. 5, 6, 7, and 10-12. In some embodiments, the SV40 poly A signal may comprise the nucleic acid sequence of SEQ ID NO: 27, 10014, 10114, 10214, 10514, 11014, 11214, or 11714. In some embodiments, the bGH poly A signal may comprise the nucleic acid sequence of SEQ ID NO: 10016, 10116, 10216, 11016, 11116, 11216, 11316, 11516, or 11714. In some embodiments, both SV40 poly A and bGH poly A signals may be used in tandem. In such cases, the poly A signal may comprise the nucleic acid sequence of SEQ ID NO: 306, 405, 10035, 10135, 10235, 11035, 11235, or 11735.

Examples of suitable enhancers include, e.g., the CMV enhancer, the RSV enhancer, the alpha fetoprotein enhancer, the TTR minimal promoter/enhancer, LSP (TH-binding globulin promoter/alpha 1-microglobulin/bikunin enhancer), an APB enhancer, ABPS enhancer, an alpha mic/bik enhancer, TTR enhancer, en34, ApoE amongst others. In some embodiments, the CMV enhancer may comprise a reference CMV sequence provided by Accession No: NC_006273. In some embodiments, the CMV enhancer may comprise the nucleic acid sequence of SEQ ID NO: 7, 10005, 10105, 10205, 10505, 11005, 11105, 11205, 11305, 11505, or 11705.

In one embodiment, a Kozak sequence, such as 'CCACC' or a sequence representing an approach to the consensus sequence for optimal protein translation initiation: GCCRCCATGG, is included upstream of the human ABCD1 coding sequence to enhance translation from the correct initiation codon. In another embodiment, CBA exon 1 and intron are included in the expression cassette. In one embodiment, the human ABCD1 coding sequence is placed under the control of a hybrid promoter. In some instances, a hybrid promoter comprises a cytomegalovirus (CMV) immediate early enhancer, the proximal chicken beta actin promoter, and CBA exon 1 flanked by intron 1 sequences.

In another embodiment, the intron is selected from CBA, human beta globin, IVS2, SV40, bGH, alpha-globulin, beta-globulin, collagen, ovalbumin, p53, rabbit beta globin or a fragment thereof. An exemplary CBA intron may comprise a sequence provided by, e.g., Accession No. X00182. An exemplary rabbit beta globin intron may comprise a sequence provided by, e.g., Accession No. V00882. An exemplary intron may comprise the nucleic acid sequence of SEQ ID NOS: 12, 10009, 10109, 10209, 10509, 11009, 11109, 11209, 11309, 11509, or 11709.

In one embodiment, the expression cassette, the vector, the plasmid and the virus contain chicken beta-actin promoter, CMV enhancer, chicken beta-actin exon 1 and intron, human ABCD1 sequence, and SV40 and/or BGH poly A. In a further embodiment, the expression cassette includes nt 1 to 3713 of SEQ ID NO: 100.

In a further embodiment, the production plasmid has a sequence of SEQ ID NO: 100 or any of SEQ ID NOS: 10000, 10100, 10200, 10500, 11000, 11100, 11200, 11300, 11500, or 11700, or any variant thereof which is functionally equivalent.

In some preferred embodiments, the production plasmid has a sequence of SEQ ID NO:10000, 10100, 10200, 10500, 11000, 11100, 11200, 11300, 11500, or 11700.

In further preferred embodiments, the production plasmid has a sequence of SEQ ID NO: 10100, 11000, 11500, or 11700.

In another aspect, a method for treating ALD or AMN disease caused by a defect in the ABCD1 gene comprises delivering to a subject in need thereof a vector (such as rAAV) which encodes human ABCD1, as described herein. In one embodiment, a method of treating a subject having ALD or AMN disease with a rAAV described herein is provided.

Also provided herein are pharmaceutical compositions. The pharmaceutical compositions described herein are designed for delivery to subjects in need thereof by any suitable route or a combination of different routes.

In yet other aspects, these nucleic acid sequences, vectors, expression cassettes and rAAV viral vectors are useful in a pharmaceutical composition, which also comprises a pharmaceutically acceptable carrier, excipient, buffer, diluent, surfactant, preservative and/or adjuvant, etc. Such pharmaceutical compositions are used to stabilize the rAAV virus, prevent loss of rAAV virus during delivery, and/or help successfully express the human ABCD1 protein in the host cells through delivery by such recombinantly engineered AAVs or artificial AAVs.

To prepare these pharmaceutical compositions containing the nucleic acid sequences, vectors, expression cassettes and rAAV viral vectors, the sequences or vectors or viral vector is preferably assessed for contamination by conventional methods and then formulated into a pharmaceutical composition suitable for administration to the patient. Such formulation involves the use of a pharmaceutically and/or physiologically acceptable vehicle or carrier, such as buffered saline or other buffers, e.g., HEPES, to maintain pH at appropriate physiological levels, and, optionally, other medicinal agents, pharmaceutical agents, stabilizing agents, buffers, carriers, adjuvants, diluents, surfactant, or excipient etc. For injection, the carrier will typically be a liquid. Exemplary physiologically acceptable carriers include sterile, pyrogen-free water and sterile, pyrogen-free, phosphate buffered saline. A variety of such known carriers are provided in U.S. Pat. No. 7,629,322, incorporated herein by reference. In one embodiment, the carrier is an isotonic sodium chloride solution. In another embodiment, the carrier is balanced salt solution. In one embodiment, the carrier includes tween. If the virus is to be stored long term, it may be frozen in the presence of glycerol or Tween20.

In one exemplary specific embodiment, the composition of the carrier or excipient may contain 180 mM NaCl, 10 mM NaPi, pH 7.3 with 0.0001%-0.01% Pluronic F68 (PF68). The exact composition of the saline component of the buffer may range from 160 mM to 180 mM NaCl. Optionally, a different pH buffer (potentially HEPES, sodium bicarbonate, TRIS) may be used in place of the buffer specifically described. Still alternatively, a buffer containing 0.9% NaCl may be used.

As used herein, the term "dosage" can refer to the total dosage delivered to the subject in the course of treatment, or the amount delivered in a single unit (or multiple unit or split dosage) administration. The pharmaceutical virus compositions can be formulated in dosage units to contain an amount of replication-defective virus carrying the codon optimized nucleic acid sequences encoding human ABCD1 as described herein that is in the range of about $1.0 \times 10^9$ GC to about $1.0 \times 10^{16}$ GC per dose including all integers or fractional amounts within the range. In one embodiment, the compositions are formulated to contain at least $1 \times 10^9$, $2 \times 10^9$, $3 \times 10^9$, $4 \times 10^9$, $5 \times 10^9$, $6 \times 10^9$, $7 \times 10^9$, $8 \times 10^9$, or $9 \times 10^9$ GC per dose including all integers or fractional amounts within the range. In another embodiment, the compositions are formulated to contain at least $1 \times 10^{10}$, $2 \times 10^{10}$, $3 \times 10^{10}$, $4 \times 10^{10}$, $5 \times 10^{10}$, $6 \times 10^{10}$, $7 \times 10^{10}$, $8 \times 10^{10}$, or $9 \times 10^{10}$ GC per dose including all integers or fractional amounts within the range. In another embodiment, the compositions are formulated to contain at least $1 \times 10^{11}$, $2 \times 10^v$, $3 \times 10^{11}$, $4 \times 10^{11}$, $5 \times 10^{11}$, $6 \times 10^{11}$, $7 \times 10^{11}$, $8 \times 10^{11}$, or $9 \times 10^{11}$ GC per dose including all integers or fractional amounts within the range. In another embodiment, the compositions are formulated to contain at least $1 \times 10^{12}$, $2 \times 10^{12}$, $3 \times 10^{12}$, $4 \times 10^{12}$, $5 \times 10^{12}$, $6 \times 10^{12}$, $7 \times 10^{12}$, $8 \times 10^{12}$, or $9 \times 10^{12}$ GC per dose including all integers or fractional amounts within the range. In another embodiment, the compositions are formulated to contain at least $1 \times 10^{13}$, $2 \times 10^{13}$, $3 \times 10^{13}$, $4 \times 10^{13}$, $5 \times 10^{13}$, $6 \times 10^{13}$, $7 \times 10^{13}$, $8 \times 10^{13}$, or $9 \times 10^{13}$ GC per dose including all integers or fractional amounts within the range. In another embodiment, the compositions are formulated to contain at least $1 \times 10^{14}$, $2 \times 10^{14}$, $3 \times 10^{14}$, $4 \times 10^{14}$, $5 \times 10^{14}$, $6 \times 10^{14}$, $7 \times 10^{14}$, $8 \times 10^{14}$, or $9 \times 10^{14}$ GC per dose including all integers or fractional amounts within the range. In another embodiment, the compositions are formulated to contain at least $1 \times 10^{15}$, $2 \times 10^{15}$, $3 \times 10^{15}$, $4 \times 10^{15}$, $5 \times 10^{15}$, $6 \times 10^{15}$, $7 \times 10^{15}$, $8 \times 10^{15}$, or $9 \times 10^{15}$ GC per dose including all integers or fractional amounts within the range. In one embodiment, for human application the dose can range from $1 \times 10^{10}$ to about $1 \times 10^{12}$ GC per dose including all integers or fractional amounts within the range. All dosages may be measured by any known method, including as measured by qPCR or digital droplet PCR (ddPCR) as described in, e.g., M. Lock et al, *Hum Gene Ther Methods*. 2014 April; 25(2): 115-25. doi: 10. 1089/hgtb.2013.131, which is incorporated herein by reference.

In one embodiment, an aqueous suspension suitable for administration to an ALD or AMN patient is provided. The suspension comprises an aqueous suspending liquid and about $7.5\times10^9$ GC or viral particles to about $1\times10^{12}$ GC or viral particles per gram of brain of a recombinant adeno-associated virus (rAAV) described herein useful as a therapeutic for ALD or AMN disease.

It may also be desirable to administer multiple "booster" dosages of the pharmaceutical compositions of this invention. For example, depending upon the duration of the transgene within the CNS, one may deliver booster dosages at 6-month intervals, or yearly following the first administration. The fact that AAV-neutralizing antibodies were not generated by administration of the rAAV vector should allow additional booster administrations.

Such booster dosages and the need therefor can be monitored by the attending physicians, using, for example, the human ABCD1 activity, and/or neurologic tests. Other similar tests may be used to determine the status of the treated subject over time. Selection of the appropriate tests may be made by the attending physician. Still alternatively, the method of this invention may also involve injection of a larger volume of virus-containing solution in a single or multiple infection to allow ABCD1 activity levels close to those found in normal subjects.

These above doses may be administered in a variety of volumes of carrier, excipient or buffer formulation, ranging from about 100 microliters to about 150 mL, including all numbers within the range, depending on the size of the patient, the viral titer used, the route of administration, and the desired effect of the method. In one embodiment, the volume of carrier, excipient or buffer is at least about 500 µL. In one embodiment, the volume is about 750 µL. In another embodiment, the volume is about 1 mL. In another embodiment, the volume is about 2 mL. In another embodiment, the volume is about 3 mL. In another embodiment, the volume is about 4 mL. In another embodiment, the volume is about 5 mL. In another embodiment, the volume is about 6 mL. In another embodiment, the volume is about 7 mL. In another embodiment, the volume is about 8 mL. In another embodiment, the volume is about 9 mL. In another embodiment, the volume is about 10 mL. In another embodiment, the volume is about 11 mL. In another embodiment, the volume is about 12 mL. In another embodiment, the volume is about 13 mL. In another embodiment, the volume is about 14 mL. In another embodiment, the volume is about 15 mL. In another embodiment, the volume is about 16 mL. In another embodiment, the volume is about 17 mL. In another embodiment, the volume is about 18 mL. In another embodiment, the volume is about 19 mL. In another embodiment, the volume is about 20 mL. In another embodiment, the volume is about 21 mL. In another embodiment, the volume is about 22 mL. In another embodiment, the volume is about 23 mL. In another embodiment, the volume is about 24 mL. In another embodiment, the volume is about 25 mL or more. In one embodiment, the maximum injected volume is about 10% of total cerebrospinal fluid volume. In another embodiment, the volume is between about 50 mL and about 150 mL. In another embodiment, the volume is about 50 mL. In another embodiment, the volume is about 60 mL. In another embodiment, the volume is about 70 mL. In another embodiment, the volume is about 80 mL. In another embodiment, the volume is about 90 mL. In another embodiment, the volume is about 100 mL. In another embodiment, the volume is about 110 mL. In another embodiment, the volume is about 120 mL. In another embodiment, the volume is about 130 mL. In another embodiment, the volume is about 140 mL. In another embodiment, the volume is about 150 mL. In a preferred embodiment, the volume is about 100 mL.

In one embodiment, the viral constructs may be delivered in doses of from at least $1\times10^9$ to about least $1\times10^{13}$ GCs in volumes of about 100 microliters to about 1 mL for small animal subjects, such as mice. For larger veterinary subjects, the larger human dosages and volumes stated above are useful. See, e.g., Diehl et al, *J. Applied Toxicology*, 21: 15-23 (2001) for a discussion of good practices for administration of substances to various veterinary animals. This document is incorporated herein by reference.

It is desirable that the lowest effective concentration of virus or other delivery vehicle be utilized in order to reduce the risk of undesirable effects, such as toxicity. Still other dosages in these ranges may be selected by the attending physician, considering the physical state of the subject, preferably human, being treated, the age of the subject, and the degree to which the disorder, has developed.

Yet another aspect described herein is a method of treating or preventing adrenoleukodystrophy (ALD) and/or adrenomyeloneuropathy (AMN) and/or ameliorating symptoms associated therewith in a mammalian subject. In one embodiment, an rAAV carrying the ABCD1 native, modified or codon optimized sequence, preferably suspended in a physiologically compatible carrier, diluent, excipient and/or adjuvant, may be administered to a desired subject including a human subject in a therapeutically effective amount. This method comprises administering to a subject in need thereof any of the nucleic acid sequences, expression cassettes, rAAV genomes, plasmids, vectors or rAAV vectors or compositions containing them.

In one embodiment, the composition is delivered intrathecally. In another embodiment, the composition is delivered via ICV. In another embodiment, the composition is delivered via intracisternal administration. In still another embodiment, the composition is delivered using a combination of administrative routes suitable for treatment of ALD or AMN disease and may also involve intravenous administration or other conventional administration routes.

For use in these methods, the volume and viral titer of each dosage is determined individually, as further described herein. The dosages, administrations and regimens may be determined by the attending physician given the teachings of this specification. In another embodiment, the method involves administering the compositions in two or more dosages (e.g., split dosages). In another embodiment, a second administration of an rAAV including the selected expression cassette (e.g., ABCD1 containing cassette) is performed at a later time point. Such time point may be weeks, months or years following the first administration. Such second administration is, in one embodiment, performed with an rAAV having a different capsid than the rAAV from the first administration. In another embodiment, the rAAV from the first and second administration have the same capsid.

In still other embodiments, the compositions described herein may be delivered in a single composition or multiple compositions. Optionally, two or more different AAV may be delivered, or multiple viruses (see, e.g., WO 2011/126808 and WO 2013/049493). In another embodiment, multiple viruses may contain different replication-defective viruses (e.g., AAV and adenovirus).

According to the present invention, a "therapeutically effective amount" of the human ABCD1 vector is delivered as described herein to achieve a desired result, i.e., treatment of ALD or AMN disease or one or more symptoms thereof. In one embodiment, the goal of treatment is to limit progression of the disease. This may be assessed by a quantitative and qualitative evaluation of symptoms, such as described previously.

In another embodiment, the method includes performing additional testing, e.g., assays and neurologic testing to determine the efficacy of the treatment. Such tests include those performed as part of the UBDRS, and include, without limitation, assessment of: speech clarity, tongue protrusion, visual acuity, tone (arms, legs, neck), strength (arms, legs), hand tapping, heel stomping, spontaneous movements (akinesia), Stereotypies, Dystonia, myoclonus, tremor, chorea, dysmetria, gait, postural stability, seizures, behavior and mood, and overall health.

In one embodiment of the methods described herein, a one-time delivery of a composition as described herein, e.g., an AAV delivery of an optimized human ABCD1 cassette, is useful in treating ALD or AMN disease in a subject. In another embodiment of the methods described herein, a one-time delivery of a composition as described herein, e.g., an AAV delivery of an optimized human ABCD1 cassette, is useful in preventing ALD or AMN disease in a subject having a defect in the ABDC1 gene.

Thus, in one embodiment, the composition is administered before disease onset. In another embodiment, the composition is administered prior to the initiation of neurological impairment. In another embodiment, the composition is administered after initiation of neurological impairment. In one embodiment, neonatal treatment is defined as being administered an ABCD1 coding sequence, expression cassette or vector as described herein within 8 hours, the first 12 hours, the first 24 hours, or the first 48 hours of delivery. In another embodiment, particularly for a primate (human or non-human), neonatal delivery is within the period of about 12 hours to about 1 week, 2 weeks, 3 weeks, or about 1 month, or after about 24 hours to about 48 hours. In another embodiment, the composition is delivered after onset of symptoms. In one embodiment, treatment of the patient (e.g., a first injection) is initiated prior to the first year of life. In another embodiment, treatment is initiated after the first 1 year, or after the first 2 to 3 years of age, after 5 years of age, after 11 years of age, or at an older age. In one embodiment, treatment is initiated from ages about 4 years of age to about 12 years of age. In one embodiment, treatment is initiated on or after about 4 years of age. In one embodiment, treatment is initiated on or after about 5 years of age. In one embodiment, treatment is initiated on or after about 6 years of age. In one embodiment, treatment is initiated on or after about 7 years of age. In one embodiment, treatment is initiated on or after about 8 years of age. In one embodiment, treatment is initiated on or after about 9 years of age. In one embodiment, treatment is initiated on or after about 10 years of age. In one embodiment, treatment is initiated on or after about 11 years of age. In one embodiment, treatment is initiated on or after about 12 years of age. However, treatment can be initiated on or after about 15, about 20, about 25, about 30, about 35, or about 40 years of age. In one embodiment, treatment in utero is defined as administering the composition as described herein in the fetus. See, e.g., David et al, Recombinant adeno-associated virus-mediated in utero gene transfer gives therapeutic transgene expression in the sheep, *Hum Gene Ther.* 2011 April; 22(4):419-26. doi: 10. 1089/hum.2010.007. Epub 2011 Feb. 2, which is incorporated herein by reference.

In another embodiment, the composition is re-administered at a later date. Optionally, more than one re-administration is permitted. Such re-administration may be with the same type of vector, a different viral vector, or via non-viral delivery as described herein.

The goals of the treatments described herein include limiting or halting the progression of ALD or AMN disease. Desirable results of the treatments include, without limitation, increases in any of the assessment scores of the UBDRS, an increase in ABCD1 activity or expression levels, reduction in the amount of VLCFA's or stabilization of or a slowing of the increase of VLCFA's in the subject, increase in (or reduction in progression of impairment of) motor function, as determined by neurologic testing, and increase in (or reduction in progression of impairment of) cortical volume by MRI. A desired result includes reducing muscle weakness, increasing muscle strength and tone, or maintaining or increasing respiratory health, or reducing tremors or twitching. Other desired endpoints can be determined by a physician.

In yet another embodiment, any of the above described methods is performed in combination with another, or secondary, therapy. The secondary therapy may be any now known, or as yet unknown, therapy which helps prevent, arrest or ameliorate these mutations or defects or any of the effects associated therewith. The secondary therapy can be administered before, concurrent with, or after administration of the compositions described above. In one embodiment, a method of generating a recombinant rAAV comprises obtaining a plasmid containing an AAV expression cassette as described above and culturing a packaging cell carrying the plasmid in the presence of sufficient viral sequences to permit packaging of the AAV viral genome into an infectious AAV envelope or capsid. Specific methods of rAAV vector generation are described above and may be employed in generating a rAAV vector that can deliver the ABCD1 gene in the expression cassettes and genomes described herein.

In certain embodiments of this invention, a subject has ALD or AMN disease, for which the components, compositions and methods of this invention are designed to treat. As used herein, the term "subject" as used herein means a mammalian animal, including a human, a veterinary or farm animal, a domestic animal or pet, and animals normally used for clinical research. In one embodiment, the subject of these methods and compositions is a human. Still other suitable subjects include, without limitation, murine, rat, canine, feline, porcine, bovine, ovine, non-human primate and others. As used herein, the term "subject" is used interchangeably with "patient".

As used herein, the term "treatment" or "treating" is defined encompassing administering to a subject one or more compounds or compositions described herein for the purposes of amelioration of one or more symptoms of ALD or AMN disease. "Treatment" can thus include one or more of reducing onset or progression of ALD or AMN disease, preventing disease, reducing the severity of the disease symptoms, or retarding their progression, including the progression of neurological impairment, removing the disease symptoms, delaying onset of disease or monitoring progression of disease or efficacy of therapy in a given subject.

In one aspect, an AAV vector is provided which encodes a functional human ABCD1 protein. By "functional hABCD1", is meant a gene which encodes an ABCD1 protein which provides at least about 50%, at least about 75%, at least about 80%, at least about 90%, or about the same, or greater than 100% of the biological activity level of the native ABCD1 protein, or a natural variant or polymorph thereof which is not associated with disease.

A variety of assays exist for measuring ABCD1 expression and activity levels in vitro. The methods described herein can also be combined with any other therapy for treatment of ALD or AMN disease or the symptoms thereof.

In certain embodiments, the AAV-ABCD1 viral vector is produced. A number of suitable purification methods may be selected. Examples of suitable purification methods are described, e.g., International Patent Application No. PCT/US2016/065970, filed Dec. 9, 2016 and its priority documents, US Patent Application Nos. 62/322,071, filed Apr. 13, 2016 and 62/226,357, filed Dec. 11, 2015 and entitled "Scalable Purification Method for AAV9", which is incorporated by reference herein.

In the case of AAV viral vectors, quantification of the genome copies ("GC") may be used as the measure of the dose contained in the formulation. Any method known in the art can be used to determine the genome copy (GC) number of the replication-defective virus compositions of the invention. One method for performing AAV GC number titration is as follows: Purified AAV vector samples are first treated with DNase to eliminate contaminating host DNA from the production process. The DNase resistant particles are then subjected to heat treatment to release the genome from the capsid. The released genomes are then quantitated by real-time PCR using primer/probe sets targeting specific region of the viral genome (for example poly A signal). Another suitable method for determining genome copies are the quantitative-PCR (qPCR), particularly the optimized qPCR or digital droplet PCR [Lock Martin, et al, *Human Gene Therapy Methods*. April 2014, 25(2): 115-125. doi: 10.1089/hgtb.2013.131, published online ahead of editing Dec. 13, 2013] Alternatively, ViroCyt3100 can be used for particle quantitation, or flow cytometry. In another method, the effective dose of a recombinant adeno-associated virus carrying a nucleic acid sequence encoding the ABCD1 coding sequence is measured as described in S. K. McLaughlin et al, 1988, *J. Virol.*, 62: 1963, which is incorporated by reference in its entirety.

The replication-defective virus compositions can be formulated in dosage units to contain an amount of replication-defective virus that is in the range of about $1.0 \times 10^9$ GC to about $9 \times 10^{15}$ GC (to treat an average subject of 70 kg in body weight) including all integers or fractional amounts within the range, and preferably $1.0 \times 10^{12}$ GC to $1.0 \times 10^{15}$ GC for a human patient. In one embodiment, the compositions are formulated to contain at least $1 \times 10^9$, $2 \times 10^9$, $3 \times 10^9$, $4 \times 10^9$, $5 \times 10^9$, $6 \times 10^9$, $7 \times 10^9$, $8 \times 10^9$, or $9 \times 10^9$ GC per dose including all integers or fractional amounts within the range. In another embodiment, the compositions are formulated to contain at least $1 \times 10^{10}$, $2 \times 10^{10}$, $3 \times 10^{10}$, $4 \times 10^{10}$, $5 \times 10^{10}$, $6 \times 10^{10}$, $7 \times 10^{10}$, $8 \times 10^{10}$, or $9 \times 10^{10}$ GC per dose including all integers or fractional amounts within the range. In another embodiment, the compositions are formulated to contain at least $1 \times 10^{11}$, $2 \times 10^{11}$, $3 \times 10^{11}$, $4 \times 10^{11}$, $5 \times 10^{11}$, $6 \times 10^{11}$, $7 \times 10^{11}$, $8 \times 10^{11}$, or $9 \times 10^{11}$ GC per dose including all integers or fractional amounts within the range. In another embodiment, the compositions are formulated to contain at least $1 \times 10^{12}$, $2 \times 10^{12}$, $3 \times 10^{12}$, $4 \times 10^{12}$, $5 \times 10^{12}$, $6 \times 10^{12}$, $7 \times 10^{12}$, $8 \times 10^{12}$, or $9 \times 10^{12}$ GC per dose including all integers or fractional amounts within the range. In another embodiment, the compositions are formulated to contain at least $1 \times 10^{13}$, $2 \times 10^{13}$, $3 \times 10^{13}$, $4 \times 10^{13}$, $5 \times 10^{13}$, $6 \times 10^{13}$, $7 \times 10^{13}$, $8 \times 10^{13}$, or $9 \times 10^{13}$ GC per dose including all integers or fractional amounts within the range. In another embodiment, the compositions are formulated to contain at least $1 \times 10^{14}$, $2 \times 10^{14}$, $3 \times 10^{14}$, $4 \times 10^{14}$, $5 \times 10^{14}$, $6 \times 10^{14}$, $7 \times 10^{14}$, $8 \times 10^{14}$, or $9 \times 10^{14}$ GC per dose including all integers or fractional amounts within the range. In another embodiment, the compositions are formulated to contain at least $1 \times 10^{15}$, $2 \times 10^{15}$, $3 \times 10^{15}$, $4 \times 10^{15}$, $5 \times 10^{15}$, $6 \times 10^{15}$, $7 \times 10^{15}$, $8 \times 10^{15}$, or $9 \times 10^{15}$ GC per dose including all integers or fractional amounts within the range. In one embodiment, for human application the dose can range from $1 \times 10^{10}$ to about $1 \times 10^{15}$ GC per dose including all integers or fractional amounts within the range.

In one embodiment, the viral constructs may be delivered in doses of from at least about least $1 \times 10^9$ GCs to about $1 \times 10^{15}$ GC, or about $1 \times 10^{11}$ GC to $1 \times 10^{15}$ GC. Suitable volumes for delivery of these doses and concentrations may be determined by one of skill in the art. For example, volumes of about 1 μL to 150 mL may be selected, with the higher volumes being selected for adults. Typically, for newborn infants a suitable volume is about 0.5 mL to about 10 mL, for older infants, about 0.5 mL to about 15 mL may be selected. For toddlers, a volume of about 0.5 mL to about 20 mL may be selected. For children, volumes of up to about 30 mL may be selected. For pre-teens and teens, volumes up to about 50 mL may be selected. In still other embodiments, a patient may receive an intrathecal administration in a volume of about 5 mL to about 15 mL are selected, or about 7.5 mL to about 10 mL. In other embodiments, a patient may receive intrathecal administration of between 10 and 150 mL, between 50 mL and 150 mL, between 75 mL and 125 mL, or about 100 mL. Other suitable volumes and dosages may be determined. The dosage will be adjusted to balance the therapeutic benefit against any side effects and such dosages may vary depending upon the therapeutic application for which the recombinant vector is employed.

The above-described recombinant vectors may be delivered to host cells according to published methods. In certain embodiments, for administration to a human patient, the rAAV is suitably suspended in an aqueous solution containing saline, a surfactant, and a physiologically compatible salt or mixture of salts. Suitably, the formulation is adjusted to a physiologically acceptable pH, e.g., in the range of pH 6 to 9, or pH 6.5 to 7.5, pH 7.0 to 7.7, or pH 7.2 to 7.8. As the pH of the cerebrospinal fluid is about 7.28 to about 7.32, for intrathecal delivery, a pH within this range may be desired; whereas for intravenous delivery, a pH of 6.8 to about 7.2 may be desired. However, other pHs within the broadest ranges and these subranges may be selected for other route of delivery.

A suitable surfactant, or combination of surfactants, may be selected from among nonionic surfactants that are non-toxic. In one embodiment, a difunctional block copolymer surfactant terminating in primary hydroxyl groups is selected, e.g., such as Pluronic® F68 (BASF), also known as Poloxamer 188, which has a neutral pH, has an average molecular weight of 8400. Other surfactants and other Poloxamers may be selected, i.e., nonionic triblock copolymers composed of a central hydrophobic chain of polyoxypropylene (polypropylene oxide) flanked by two hydrophilic chains of polyoxyethylene (polyethylene oxide), SOLUTOL HS 15 (Macrogol-15 Hydroxystearate), LABRASOL (Polyoxy capryllic glyceride), polyoxy 10 oleyl ether, TWEEN (polyoxyethylene sorbitan fatty acid esters), ethanol and polyethylene glycol. In one embodiment, the formulation contains a poloxamer. These copolymers are commonly named with the letter "P" (for poloxamer) followed by three digits: the first two digits×100 give the approximate molecular mass of the polyoxypropylene core, and the last digit×10 gives the percentage polyoxyethylene content. In one embodiment Poloxamer 188 is selected.

The surfactant may be present in an amount up to about 0.0005% to about 0.001% of the suspension.

In one example, the formulation may contain, e.g., buffered saline solution comprising one or more of sodium chloride, sodium bicarbonate, dextrose, magnesium sulfate (e.g., magnesium sulfate-7H$_2$0), potassium chloride, calcium chloride (e.g., calcium chloride-2H$_2$O), dibasic sodium phosphate, and mixtures thereof, in water. Suitably, for intrathecal delivery, the osmolarity is within a range compatible with cerebrospinal fluid (e.g., about 275 to about 290 Osm/L). Optionally, for intrathecal delivery, a commercially available diluent may be used as a suspending agent, or in combination with another suspending agent and other optional excipients. See, e.g., Elliotts B® solution (Lukare Medical). In other embodiments, the formulation may contain one or more permeation enhancers. Examples of suitable permeation enhancers may include, e.g., mannitol, sodium glycocholate, sodium taurocholate, sodium deoxycholate, sodium salicylate, sodium caprylate, sodium caprate, sodium lauryl sulfate, polyoxyethylene-9-laurel ether, or EDTA.

In another embodiment, the composition includes a carrier, diluent, excipient and/or adjuvant. Suitable carriers may be readily selected by one of skill in the art in view of the indication for which the transfer virus is directed. For example, one suitable carrier includes saline, which may be formulated with a variety of buffering solutions (e.g., phosphate buffered saline). Other exemplary carriers include sterile saline, lactose, sucrose, calcium phosphate, gelatin, dextran, agar, pectin, peanut oil, sesame oil, and water. The buffer/carrier should include a component that prevents the rAAV, from sticking to the infusion tubing but does not interfere with the rAAV binding activity in vivo.

Optionally, the compositions of the invention may contain, in addition to the rAAV and carrier(s), other conventional pharmaceutical ingredients, such as preservatives, or chemical stabilizers. Suitable exemplary preservatives include chlorobutanol, potassium sorbate, sorbic acid, sulfur dioxide, propyl gallate, the parabens, ethyl vanillin, glycerin, phenol, and parachlorophenol. Suitable chemical stabilizers include gelatin and albumin.

The compositions according to the present invention may comprise a pharmaceutically acceptable carrier, such as defined above. Suitably, the compositions described herein comprise an effective amount of one or more AAV suspended in a pharmaceutically suitable carrier and/or admixed with suitable excipients designed for delivery to the subject via injection, pump, intrathecal catheter, or for delivery by another device or route. In one example, the composition is formulated for intrathecal delivery. In one embodiment, intrathecal delivery encompasses an injection into the spinal canal, e.g., the subarachnoid space. In one embodiment, the route of delivery is intracerebroventricular injection (ICV). In another embodiment, the route of delivery is intrathecal-lumbar (IT-L) delivery. In another embodiment, the route of delivery is intracisternal administration.

The viral vectors described herein may be used in preparing a medicament for delivering ABCD1 protein to a subject (e.g., a human patient) in need thereof, supplying functional ABCD1 to a subject, and/or for treating ALD or AMN disease. A course of treatment may optionally involve repeat administration of the same viral vector (e.g., an AAV2, AAV9, or AAVrh.10 vector) or a different viral vector (e.g., a different AAV2, AAV9 and an AAVrh.10). Still other combinations may be selected using the viral vectors and non-viral delivery systems described herein.

The ABCD1 cDNA sequences described herein can be generated in vitro and synthetically, using techniques well known in the art. For example, the PCR-based accurate synthesis (PAS) of long DNA sequence method may be utilized, as described by Xiong et al, PCR-based accurate synthesis of long DNA sequences, *Nature Protocols* 1, 791-797 (2006). A method combining the dual asymmetrical PCR and overlap extension PCR methods is described by Young and Dong, Two-step total gene synthesis method, *Nucleic Acids Res.* 2004; 32(7): e59. See also, Gordeeva et al, *J Microbiol Methods*. Improved PCR-based gene synthesis method and its application to the *Citrobacter freundii* phytase gene codon modification. 2010 May; 81(2): 147-52. Epub 2010 Mar. 10; see, also, the following patents on oligonucleotide synthesis and gene synthesis, Gene Seq. 2012 April; 6(1): 10-21; U.S. Pat. Nos. 8,008,005; and 7,985,565. Each of these documents is incorporated herein by reference. In addition, kits and protocols for generating DNA via PCR are available commercially. These include the use of polymerases including, without limitation, Taq polymerase; OneTaq® (New England Biolabs); Q5® High-Fidelity DNA Polymerase (New England Biolabs); and GoTaq® G2 Polymerase (Promega). DNA may also be generated from cells transfected with plasmids containing the hOTC sequences described herein.

Kits and protocols are known and commercially available and include, without limitation, QIAGEN plasmid kits; Chargeswitch® Pro Filter Plasmid Kits (Invitrogen); and GenElute™ Plasmid Kits (Sigma Aldrich). Other techniques useful herein include sequence-specific isothermal amplification methods that eliminate the need for thermocycling. Instead of heat, these methods typically employ a strand-displacing DNA polymerase, like Bst DNA Polymerase, Large Fragment (New England Biolabs), to separate duplex DNA. DNA may also be generated from RNA molecules through amplification via the use of Reverse Transcriptases (RT), which are RNA-dependent DNA Polymerases. RTs polymerize a strand of DNA that is complimentary to the original RNA template and is referred to as cDNA. This cDNA can then be further amplified through PCR or isothermal methods as outlined above. Custom DNA can also be generated commercially from companies including, without limitation, GenScript; GENEWIZ®; GeneArt® (Life Technologies); and Integrated DNA Technologies.

It is to be noted that the term "a" or "an" refers to one or more. As such, the terms "a" (or "an"), "one or more," and "at least one" are used interchangeably herein.

The words "comprise", "comprises", and "comprising" are to be interpreted inclusively rather than exclusively. The words "consist", "consisting", and its variants, are to be interpreted exclusively, rather than inclusively. While various embodiments in the specification are presented using "comprising" language, under other circumstances, a related embodiment is also intended to be interpreted and described using "consisting of" or "consisting essentially of" language.

As used herein, "disease", "disorder" and "condition" are used interchangeably, to indicate an abnormal state in a subject.

As used herein, the term "about" or "~" means a variability of 10% from the reference given, unless otherwise specified.

The term "regulation" or variations thereof as used herein refers to the ability of a composition to inhibit one or more components of a biological pathway.

Unless defined otherwise in this specification, technical and scientific terms used herein have the same meaning as commonly understood by one of ordinary skill in the art and by reference to published texts, which provide one skilled in the art with a general guide to many of the terms used in the present application.

EXAMPLES

The following examples are provided in order to illustrate the invention but are not to be construed as limiting the scope of the claims in any way. The plasmid sequences used in the EXAMPLES herein are as identified by the SEQ ID NOs shown in FIGS. 10-12, and in the Sequence Listing.

Materials and Methods

The following examples unless otherwise indicated were effected using the AAV-hABCD1 constructs. These AAV-hABCD1 constructs are intended to be exemplary and the invention embraces the construction and use of variants thereof.

Example 1: Intrathecal Administration of AAV9 Vector in ABCD1 Knockout Mice

In this example a short-term in vivo study was conducted in order to compare the effects of different AAV9 on ABCD1 expression levels in the spinal cord and CNS, and overt toxicity. The objective of these experiments was the identification of suitable candidates for treating ALD or AMN.

AAV vectors comprising AAV9 capsids were produced briefly as described in Gong Y. et al., 2015 May; *Mol Ther.* 23(5):824-834 and Gong Y. et al., 2019 May; *Hum Gene Ther.* 30(5):544-555. Briefly, Human 293T cells were initially transfected with a pool of siRNA to ABCD1 using the DharmaFECT reagent, and 24 hours later cells were transfected with a rAAV Genome Vector plasmid of interest (plasmid for AAV-CBA-ABCD1-WPRE(original), AAV-CBA-ABCD1-WPRE X inactiv., or AAV-CBA-ABCD1 (no WPRE)), the Rep/Cap plasmid pAAV2/9, and Ad helper plasmid pFd6. rAAV vectors were purified via CsCl gradient centrifugation, followed by desalting and concentration. The rAAV titers were determined by qPCR. The siRNA was included to reduce ABCD1 expression during the production process.

The pAAV2/9 plasmid used comprised the full construct sequence of SEQ ID NO: 700, which comprises: an AAV2 p5 promoter (SEQ ID NO: 710) from which AAV2 REP78 (SEQ ID NO: 711) and AAV2 REP68 (SEQ ID NO: 712) may be produced; an AAV2 p19 promoter (SEQ ID NO: 720) from which AAV2 REP52 (SEQ ID NO: 721) and AAV2 REP40 (SEQ ID NO: 722) may be produced; and a AAV2 p40 promoter (SEQ ID NO: 730) from which AAV9 VP1 (SEQ ID NO: 731), AAV9 VP2 (SEQ ID NO: 732), and AAV9 VP3 (SEQ ID NO: 733).

In these experiments the candidate selection criteria included identifying vectors that reduced VLCFA in the CNS equal to or greater than a vector containing a Woodchuck Hepatitis Virus (WHP) Posttranscriptional Regulatory Element (WPRE) in the absence of overt toxicity and identifying constructs which optimized biodistribution while achieving ABCD1 expression levels approximately equal to WT in individual cells.

Figure 10A:
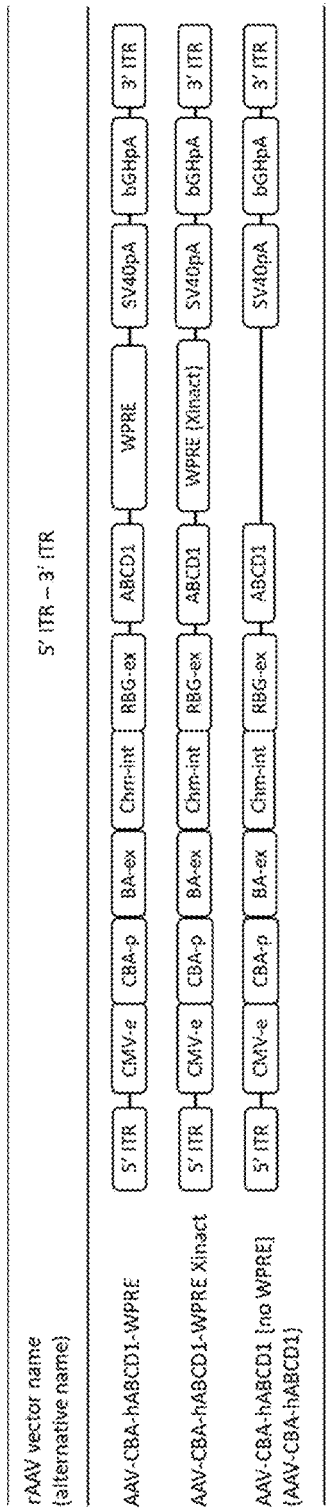
FIG. 10A compares schematics of the 5' ITR to the 3' ITR construct of the original AAV-CBA-hABCD1-WPRE viral particle, the AAV-CBA-hABCD1-WPREXinact viral particle, and the AAV-CBA-hABCD1 (no WPRE) viral particle (also referred to herein as "AAV-CBA-hABCD1"), from the 5'ITR to 3' ITR. "CMV-e", "CBA-p", "BA-ex", "Chm-int", and "RBG-ex" are elements contained in the 5' ITR-3' ITR and mean CMV enhancer, chicken beta actin promoter, beta actin exon, chimeric intron, and rabbit beta-globin exon, respectively. "ABCD1" is a polynucleotide encoding the ABCD1 gene. "SV40pA" and "bGHpA" mean SV40 poly A signal and beta growth hormone poly A signal, respectively.

In this experiment the results of which are contained in FIG. 1 different groups of 5 mice (ABCD1 knock-out (KO) mice which were about 3 months of age were each intrathecally administered a bolus injection of $1.2 \times 10^{11}$ genome copies (GC's) of different AAV vectors (see FIGS. 10-11) which were contained in phosphate buffered saline (PBS) vehicle, i.e., "AAV.ABCD1.WPRE" or "AAV-CBA-hABCD1-WPRE" (AAV vector containing ABCD1 and WPRE coding sequences, depicted in FIG. 10); "AAV.ABCD1.WPRE-Xinact" or "AAV-CBA-hABCD1-WPRE-Xinact" (AAV vector modified to comprise modified WPRE that encodes inactivated X protein, depicted in FIGS. 10 and 11A); and "AAV.ABCD1" or "AAV-CBA-hABCD1" (original AAV vector (AAV-CBA-hABCD1-WPRE) modified to remove WPRE, depicted in FIGS. 10 and 11B) or were intrathecally administered only the PBS vehicle carrier. Bolus administration was chosen as the mode of administration as it was found to be more efficient than pump infusion. Also, a control group of 5 wild-type (WT) mice were not treated.

After 3 weeks the different groups of mice were sacrificed and brain, spinal cord, dorsal root ganglion (DRG), heart and liver were harvested (with the livers being frozen for later analysis). ABCD1 expression levels as well as beta actin expression levels (for normalization) were detected in the harvested tissues by Western blot methods. These results are contained in FIG. 1. As can be seen therefrom ABCD1 expression was detected in all groups but was lower in the group administered AAV9 virus lacking a WPRE (FIG. 1A). As expected, no ABCD1 signal was detected in the negative control null mice. Quantitation of the protein expression results showed similar levels of ABCD1 protein expression between the mice treated with the vector containing the original WPRE sequence ("WPRE-original") and with the vector containing the modified X-protein sequence ("X-inactivated") while the protein expression from the vector without the WPRE sequence ("No WPRE") was reduced.

Example 2: Intrathecal Administration of Different AAV9 Constructs

Figure 11A:
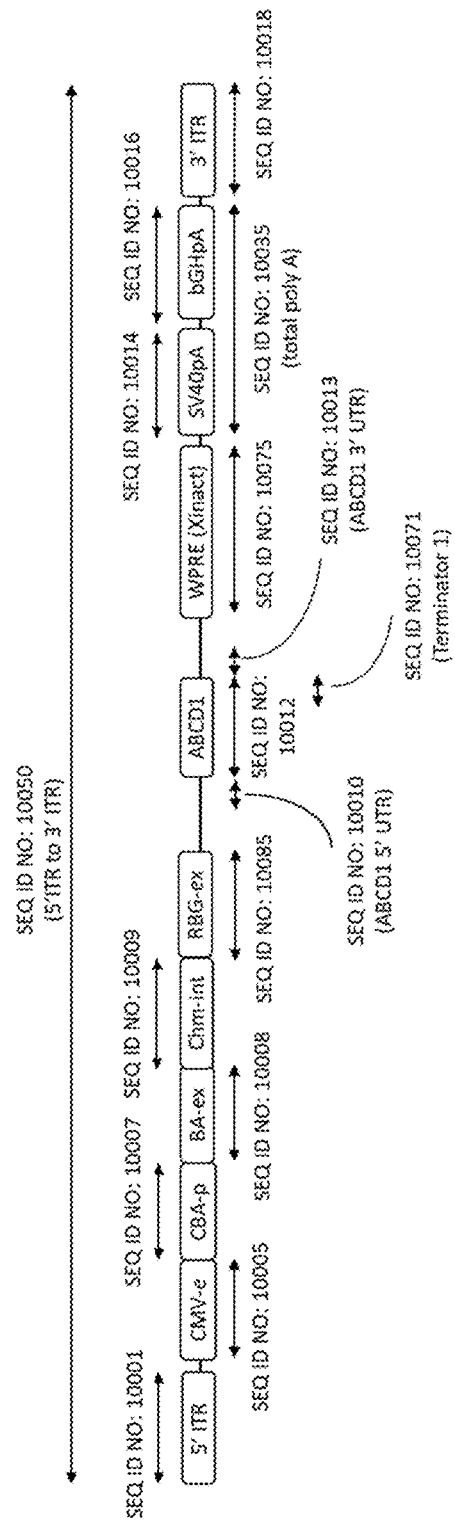
FIG. 11A provides a schematic of the AAV-CBA-hABCD1-WPRE Xinact construct with SEQ ID NOs assigned to the nucleic acid sequences of the 5' ITR, CMV enhancer, chicken β-actin promoter, β-actin exon, chimeric intron, rabbit beta-globin exon, ABCD1 5' UTR, ABCD1 gene, ABCD1 3' UTR, WPRE X inact (which is a WPRE modified to expresses an inactivated X protein partial open reading frame), SV40 polyA, bGH poly A, 3' ITR, Terminator 1 contained in the ABCD1 gene, total poly A (i.e., SV40pA to bGHpA), and the 5' ITR to 3' ITR sequence.
Figure 11B:
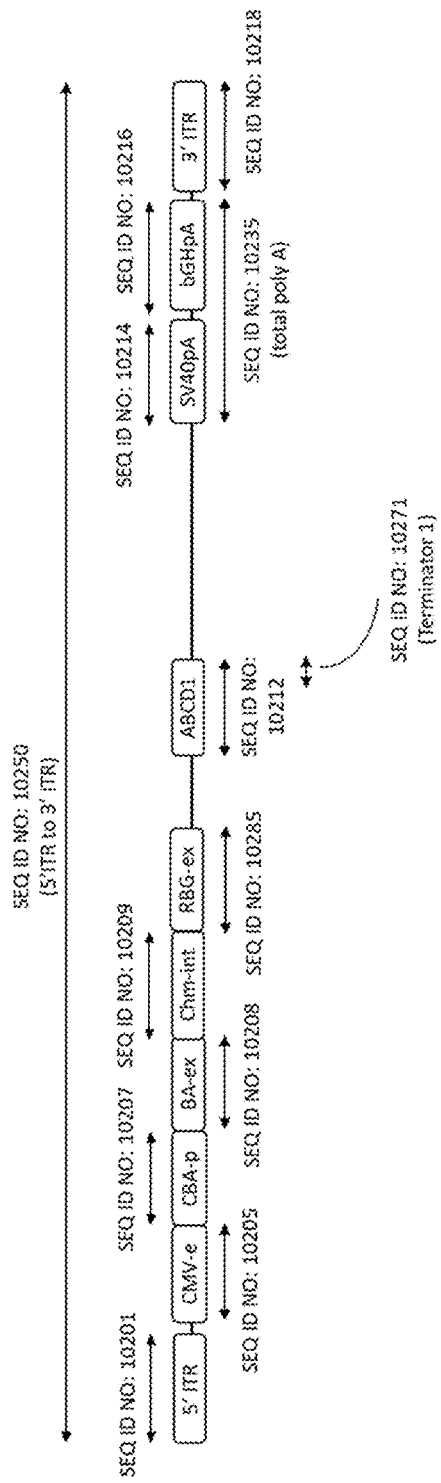
FIG. 11B contains a schematic of the AAV-CBA-hABCD1 construct (no WPRE), from the 5'ITR to 3' ITR, and SEQ ID NOs assigned to the nucleic acid sequences of the 5' ITR, CMV enhancer, chicken β-actin promoter, β-actin exon, chimeric intron, rabbit beta-globin exon, ABCD1 5' UTR, hABCD1 cDNA, Terminator 1 contained in the ABCD1 gene, ABCD1 3' UTR, SV40 polyA, bGH poly A, total poly A (i.e., SV40pA to bGHpA), 3' ITR, and the entire 5' ITR to 3' ITR sequence.

A second longer duration in vivo study was conducted wherein different groups of ABCD1 KO mice (n=5 each group) were injected intrathecally with different dosages i.e., $1 \times 10^{11}$ gc/mouse or $3 \times 10^{11}$ gc/mouse with the same exemplary AAV9 constructs shown in FIGS. 10-11. AAV viral vectors were generated and the viral titers were determined as in Example 1. As in Example 1, ABCD1 KO mice which were about 3 months of age were each intrathecally administered with a bolus of AAV9, i.e., a bolus injection of $1 \times 10^{11}$ genome copies (GC's) or $3 \times 10^{11}$ GCs of "AAV9.ABCD1.WPRE" (original AAV9 vector containing ABCD1 coding sequences, depicted in FIG. 10); "AAV9.ABCD1.WPRE-Xinact" (original AAV9 vector modified to comprise modified WPRE that encodes inactivated X protein, depicted in FIGS. 10 and 11A); or "AAV9.ABCD1" (original AAV9 vector modified to remove WPRE, depicted in FIGS. 10 and 11B) or were intrathecally administered only PBS vehicle carrier. As in the previous experiment a control group of 5 wild-type (WT) mice were not treated.

Figure 2B:
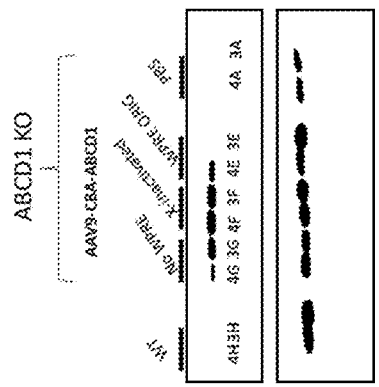
Figure 2C:
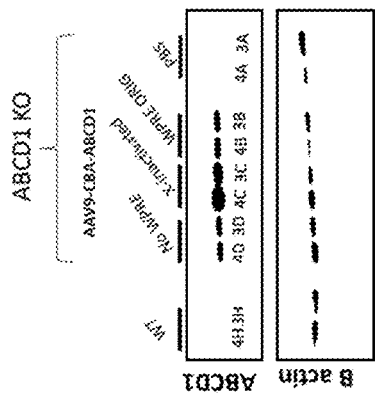

These mice were sacrificed 5 weeks post-injection and tissues were again collected for detection of ABCD1 levels in the spinal cords. In these experiments ABCD1 expression levels were detected in 2 mice from each group again using Western Blot techniques. These results may be found in FIG. 2.

In the figure ABCD1 expression levels for the mice administered $1 \times 10^{11}$ gc/mouse and $3 \times 10^{11}$ gc doses are on separate blots. The 2 second and 15 second exposure time noted in the figure refer to the ABCD1 blot. The beta actin levels on the blots are for a 10 second exposure for the $10^{11}$ gc/dose and a 5 second exposure time for the $3 \times 10^{11}$ gc dosage. ABCD1 expression was detected for all groups treated with AAV9 constructs containing the ABCD1 gene but was lower in the group administered AAV9 construct lacking a WPRE.

The dose-response of ABCD1 expression was also assessed. As shown in FIG. 3 the dose-response of the ABCD1 Western blot data in mice administered $1 \times 10^{11}$ gc/mouse or $3 \times 10^{11}$ gc doses of the AAV9 constructs containing a WPRE or an X-inactivated WPRE or AAV9 constructs lacking a WPRE was compared. The Western blot results revealed that ABCD1 expression levels were higher in the mice administered the $3 \times 10^{11}$ gc dose of the AAV9 construct containing the WPRE or containing the X-inactivated WPRE compared to those administered the $1 \times 10^{11}$ gc dose of the AAV9 construct containing the WPRE or containing the X-inactivated WPRE. The results further showed that mice administered the AAV9 construct lacking a WPRE had considerably reduced ABCD1 expression levels.

Example 3: Effects of Construct Differences on In Vitro VLCFA-Reducing Effects Since AAV9-CBA-ABCD1-WPRE (Xinact) was shown in Examples 1 and 2 to induce ABCD1 protein expression equivalent to the level induced by AAV9-CBA-ABCD1-WPRE, the effects of AAV9-CBA-ABCD1-WPRE (Xinact) on VLCFA reduction were investigated. In this experiment mixed glial cultures were produced from ABCD1 KO mice. AAV viral vectors AAV9-CBA-ABCD1-WPRE (Original) and AAV9-CBA-ABCD1-WPRE (Xinact) were generated as in Example 1. On day 12 post culture cells from the mixed glial cultures were transduced with AAV9-CBA-ABCD1 vectors at different MOIs ($1 \times 10^5$, $2.5 \times 10^5$, $5 \times 10^5$ and $1 \times 10^6$ gene copies per cell). 4 days post transduction the cells were harvested for VLCFA analysis. A subset of wells was also used for Western Blot analysis to confirm that the cells were successfully transduced.

VLCFA analysis results are shown in FIG. 4A (C26:0 levels) and FIG. 4B (ratio of C26:0 to C22:0). The results demonstrated that both AAV9 vectors lowered VLCFA levels in a dose-dependent manner and that VLCFA reduction by AAV9-CBA-ABCD1-WPRE (Xinact) was equivalent to that by AAV9-CBA-ABCD1-WPRE (Original). The results also showed that highest dose was equivalent to wild-type VLCFA levels.

Example 4: AAV-hABCD1 Vector Modifications

Another potential candidate AAV-hABCD1 construct was engineered in an effort to enhance ABCD1 expression without using WPRE and to improve other properties desired for manufacture and clinical use. Particularly modified AAV-hABCD1 vectors SBT101 and OB1005 was derived from a parental AAV construct AAV-CBA-ABCD1 [no WPRE] by a number of modifications.

In designing SBT101 from AAV-CBA-ABCD1 [no WPRE], the sequence downstream of 5' ITR was modified; and a hABCD1 5' UTR and a hABCD1 3' UTR sequences were added upstream and downstream, respectively, of the hABCD1 cDNA sequence.

In designing OB1005 from AAV-CBA-ABCD1 [no WPRE], the 5' ITR and 3' ITR sequences were shortened; ABCD1-conding sequence was modified to eliminate alternative open reading frames in order to remove its potential to express non-self-antigens; a Kozak sequence (ccacc) was added upstream of the start site to potentially improve ABCD1 translation; the second polyA signal (bGH polyA) was eliminated in order to reduce the size of the transgene cassette; and the backbone comprising the AAV2 vector was changed from pUC57 to pUC118 to improve ITR stability during scale up.

In designing OB1010 from AAV-CBA-ABCD1 [no WPRE], the 5' ITR and 3' ITR sequences were shortened; a hABCD1 5' UTR and a hABCD1 3' UTR sequences were added upstream and downstream, respectively, of the hABCD1 cDNA sequence; and the backbone comprising the AAV2 vector was changed from pUC57 to pUC118 to improve ITR stability during scale up.

Figure 5:
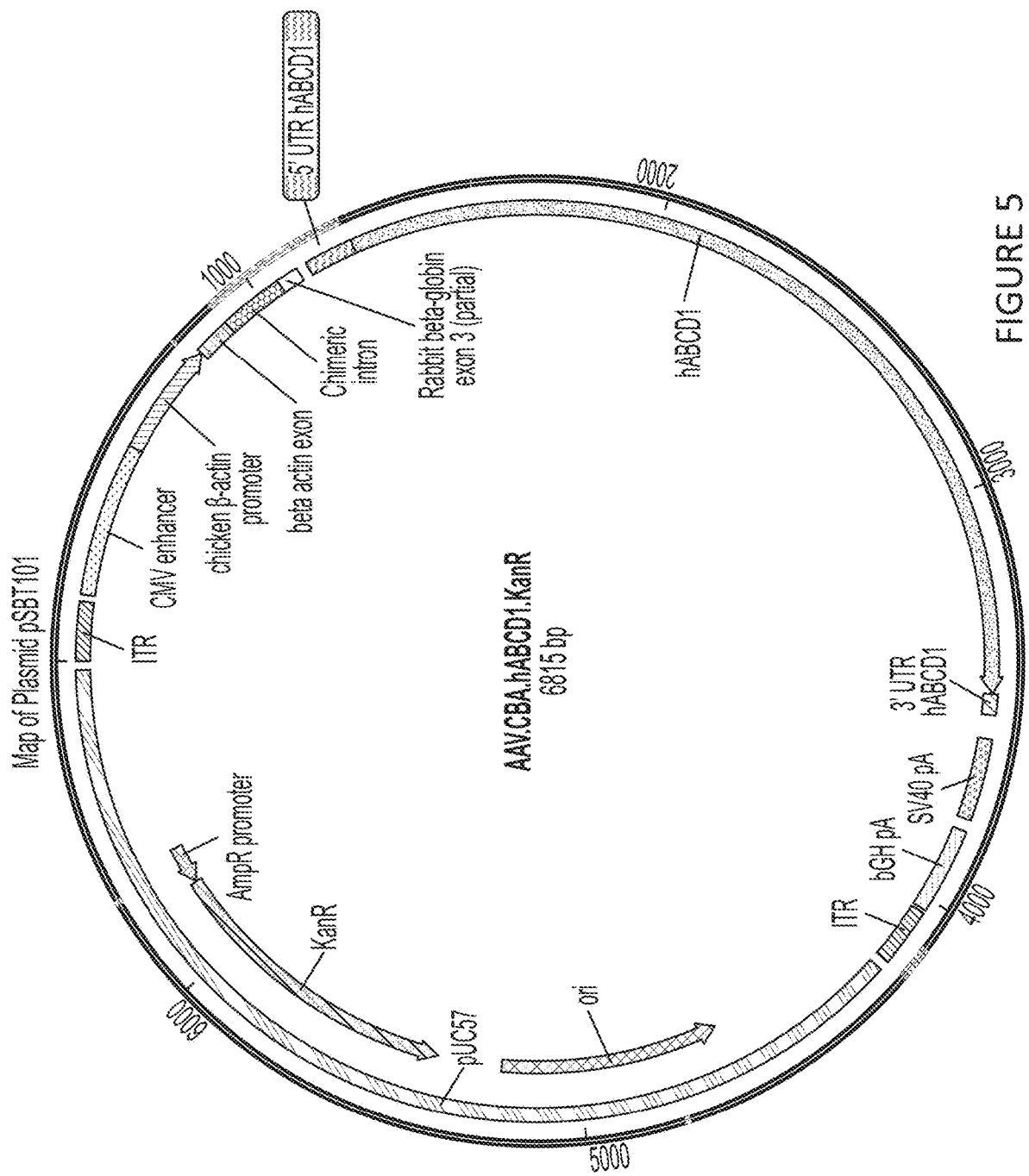
FIG. 5 contains a schematic map of pSBT101, which contains among other sequences a 5' AAV2 ITR, a CMV enhancer, a chicken beta-actin promoter, a beta-actin exon, a chimeric intron, a rabbit beta-globin exon, a hABCD1 5' UTR, the human ABCD1 coding sequence, a hABCD1 3' UTR, a SV40 poly(A) signal sequence, a bGH poly(A) signal sequence, a 3' AAV2 ITR, and a KanR marker operably linked to the AmpR promoter; wherein such sequences are contained on a pUC57 backbone.
Figure 6:
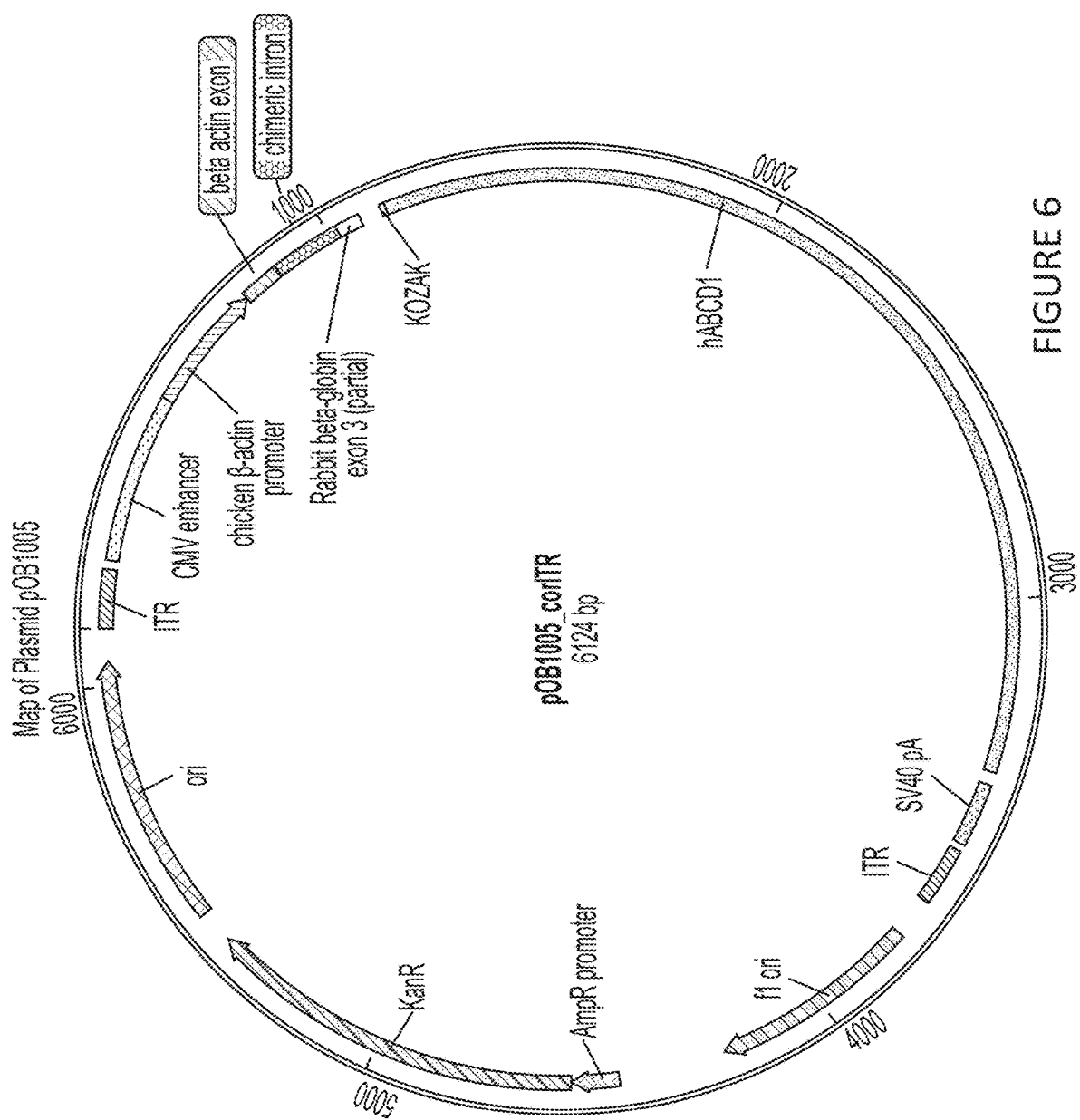
FIG. 6 contains a schematic map of pOB1005, which contains among other sequences an AAV2 5' ITR variant (shorter than the wild-type 5' ITR or the 5' ITR of pSBT101), CMV enhancer, chicken beta-actin promoter, a beta-actin exon, a beta-actin exon, a chimeric intron, a rabbit beta-globin exon, a human ABCD1 coding sequence further comprising at its 5' end a KOZAK sequence, a SV40 poly(A) signal sequence, an AAV2 3' ITR variant (shorter than the wild-type 3' ITR or the 3' ITR of pSBT101), and a KanR marker operably linked to the AmpR promoter; wherein such sequences are contained on a pUC118 backbone.
Figure 7:
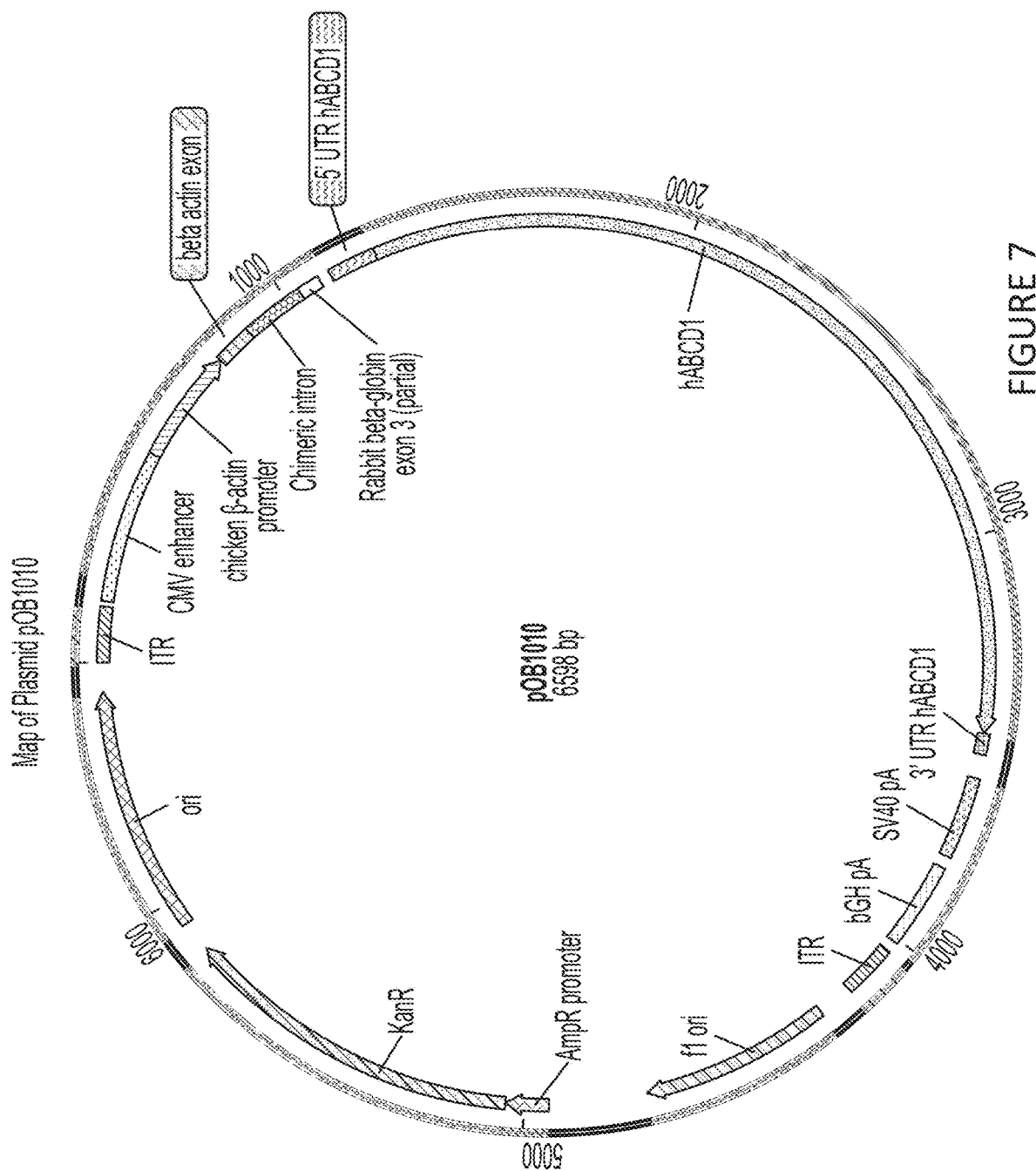
FIG. 7 contains a schematic map of pOB1010, which contains among other sequences an AAV2 5'ITR variant (shorter than the wild-type 5' ITR or the 5' ITR of pSBT101), a CMV enhancer, a chicken beta-actin promoter, a beta-actin exon, a chimeric intron, a rabbit beta-globin exon, a hABCD1 5' UTR, the human ABCD1 coding sequence, a hABCD1 3' UTR, a SV40 poly(A) signal sequence, a bGH poly(A) signal sequence, a 3' AAV2 ITR, and a KanR marker operably linked to the AmpR promoter; wherein such sequences are contained on a pUC118 backbone.

The resulting AAV vector genome plasmids pSBT101, pOB1005, and pOB1010) are respectively schematically depicted in FIG. 5, FIG. 6, and FIG. 7, respectively, The schematics and sequence details of these constructs are also provided in FIGS. 12A-E.

Example 5: Comparing ABCD1 Expression (pSTB101 vs pOB1005)

Figures 8A, 8B:
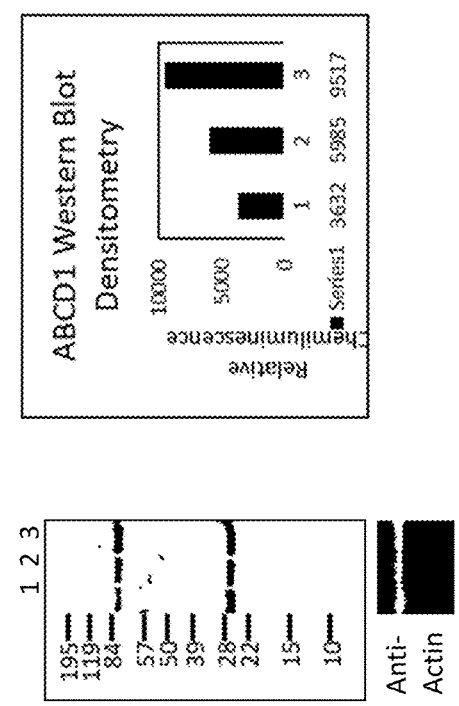
FIG. 8A-B compares ABCD1 expression levels in transient transfection experiments conducted in HEK293 cells which were transfected with pSBT101 or pOB1005 (and untransfected HEK293 control cells) wherein the plasmids were transfected side-by-side and expression was evaluated in cell lysates by Western blotting and the blots were quantified using densitometry. The anti-ALD protein antibody clone OTI4C2 (OriGene) was used in the Western blot analyses. The results show that the pOB1005 plasmid resulted in better ABCD1 expression.

An experiment was then conducted to compare the performance of pSBT101 and pOB1005 constructs in transient transfection experiments in HEK293 cells. These results are summarized in FIG. 8. ABCD1 expression levels measured by Western blot are shown in FIG. 8A. In FIG. 8B, the measured ABCD1 expression levels are compared in the bar graph in bars 2 (pSBT101, which contains no WPRE) and 3 (pOB1005). Bar 1 is the untransfected control. All bars correspond to the lanes on the gel with the same number label. Relative chemiluminescence represents ABCD1 values which are again normalized to beta-actin.

In these experiments HEK293 cells were transfected side-by-side with plasmids and expression 3 days post transfection was evaluated in cell lysates by Western blotting with the Western blots being quantified by use of densitometry. As can be seen from the results in the figure HEK293 cells transfected with the modified construct pOB1005 showed demonstrably higher ABCD1 expression than HEK293 cells transfected with pSBT101.

Example 6: Assessment of Packageability into AAV from pSBT101 and pOB1005 Constructs at Pilot Scale in Adherent Cells Additional experiments were conducted comparing the performance of pSBT101, which lacks a WPRE, with pOB1005 in triple transfection experiments effected in HEK293 cells. In these experiments HEK293 cells were transfected side-by-side with the pSBT101 or pOB1005 plasmid, alongside rep/cap plasmid (pAAV2/9 (SEQ ID NO: 700)) and Ad helper plasmid, and rAAV vectors were harvested via CsCl gradient centrifugation, followed by desalting and concentration. Packageability was then evaluated in cell lysates and supernatant by quantification of the vector genome copies post DNase treatment using ddPCR and primers specific to the transgene cassette. As was hoped pOB1005 showed demonstrably better productivity (a little over 2.5-fold increase, from $5.66 \times 10^9$ vector gc per prep to $1.48 \times 10^{10}$ vector gc per prep) in these small-scale triple transfection tests. FIG. 9 contains the results of these packageability experiments. Both pSBT101 and pOB1005 demonstrated satisfactory packageability.

Example 7: Construction of Additional Constructs with Shortened AAV2 ITRs

In an effort to further explore candidate constructs without an WPRE that may recover the ABCD1 expression and/or yield reduced in AAV-CBA-ABCD1 [no WPRE] relative to the original construct containing a WPRE, various constructs containing a set of the shortened 5' ITR and shortened 3' ITR as in pOB1005 were designed: pOB1010, pOB1011, pOB1012, pOB1013, pOB1015, and pOB1017, all of which utilize the pUC118 backbone. AAV vectors generated from pOB1010, pOB1011, pOB1012, pOB1013, pOB1015, and pOB1017 were named OB1010, OB1011, OB1012, OB1013, OB1015, and OB1017, respectively, and alternatively referred to as v1, v2, v3, v4, v5, v6, v7, and v8, respectively.

Figure 12A:
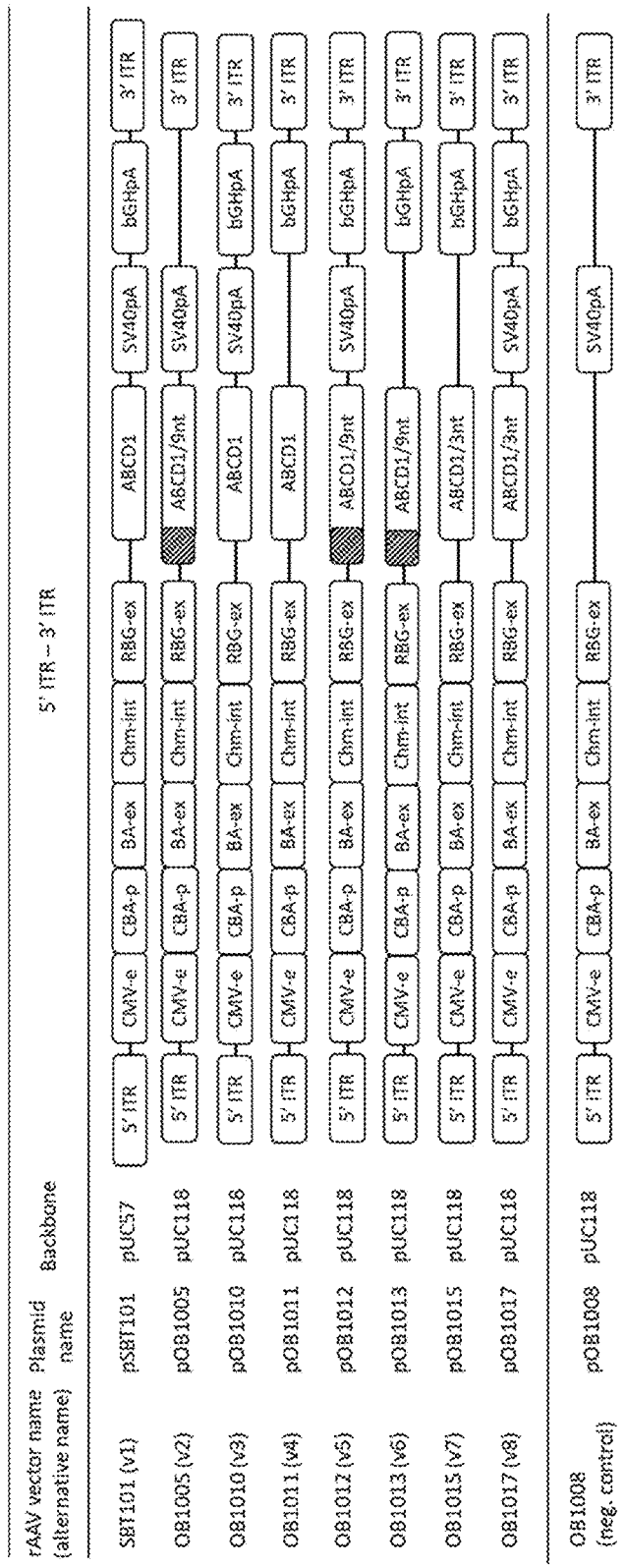
FIG. 12A compares schematics of the 5' ITR to the 3' ITR construct of the different viral particles SBT101, OB1005, OB1010, OB1011, OB1012, OB1013, OB1015, OB10107, and OB1008, from the 5'ITR to 3' ITR. "CMV-e", "CBA-p", "BA-ex", "Chm-int", and "RBG-ex" are elements contained in the 5' ITR-3' ITR and mean CMV enhancer, chicken beta actin promoter, beta actin exon, chimeric intron, and rabbit beta-globin exon, respectively. "SV40pA" and "bGHpA" mean SV40 poly A signal and beta growth hormone poly A signal, respectively. "ABCD1" is a polynucleotide encoding the ABCD1 gene. "ABCD1/3nt" and "ABCD1/9nt" contain nucleic acid differences at three and nine positions, respectively, relative to "ABCD1". The name of the plasmids (rAAV genome vectors) that encode the vector genome of the indicated rAAV viral particles and the plasmid backbones are also indicated.
Figure 12C:
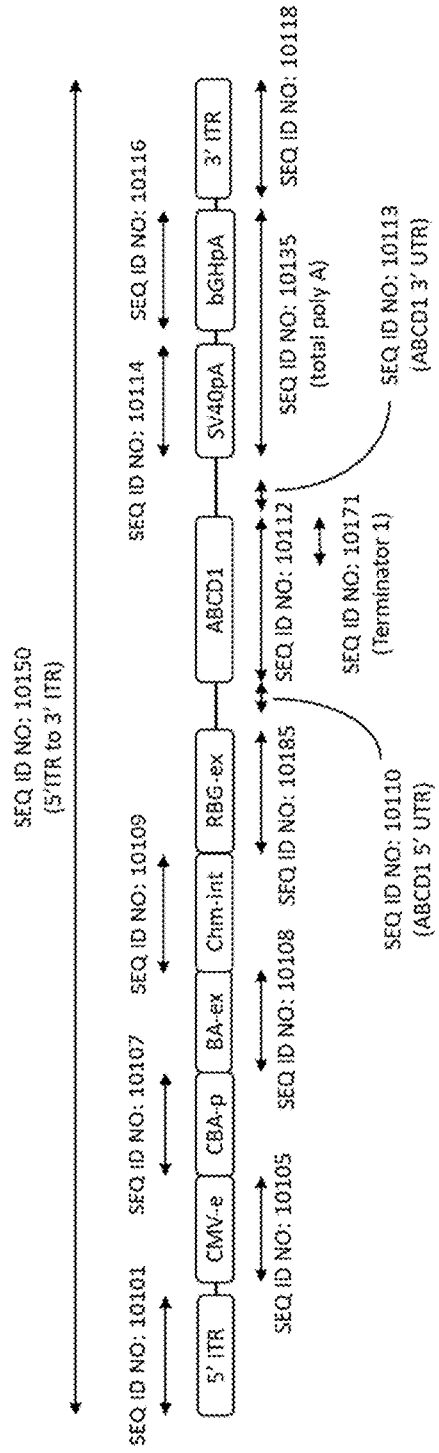
FIG. 12B provides a table summarizing SEQ ID NOs assigned to: the sequence of different elements contained in the 5' ITR-3' ITR of respective rAAV genome vectors (plasmids that may be used for producing the indicated rAAV viral particles); the 5' ITR-3' ITR sequence contained in the respective rAAV genome vectors; the rAAV vector genome sequence contained in the respective rAAV genome vectors (i.e., the sequence packaged into the indicated rAAV viral particles); and the full plasmid sequence of respective rAAV genome vectors. For example, the rAAV genome vector for OB1010, i.e., the plasmid pOB1010, has the nucleic acid sequence of SEQ ID NO: 11000, which comprises the 5'ITR-3'ITR sequence of SEQ ID NO: 11050, which comprises different elements such as the 5'ITR (SEQ ID NO: 11001), CMV enhancer (SEQ ID NO: 11005), beta actin exon (SEQ ID NO: 11008), and so forth. "Total poly A signal" refers to the region spanning from the start of SV40 poly A signal to the end of bGH poly A signal. The vector genome of the rAAV virus vector produced by pOB1010 has the nucleic acid sequence of SEQ ID NO: 11060. These SEQ ID NO assignments for respective vectors are further visually depicted in FIG. 12C-12J which visually explain SEQ ID NOS assigned to elements of the genome of different viral particles, SBT101 (FIG. 12C), OB1005 (FIG. 12D), OB1010 (FIG. 12E), OB1011 (FIG. 12F), OB1012 (FIG. 12G), OB1013 (FIG. 12H), OB1015 (FIG. 12I), and OB10107 (FIG. 12J).
Figure 12D:
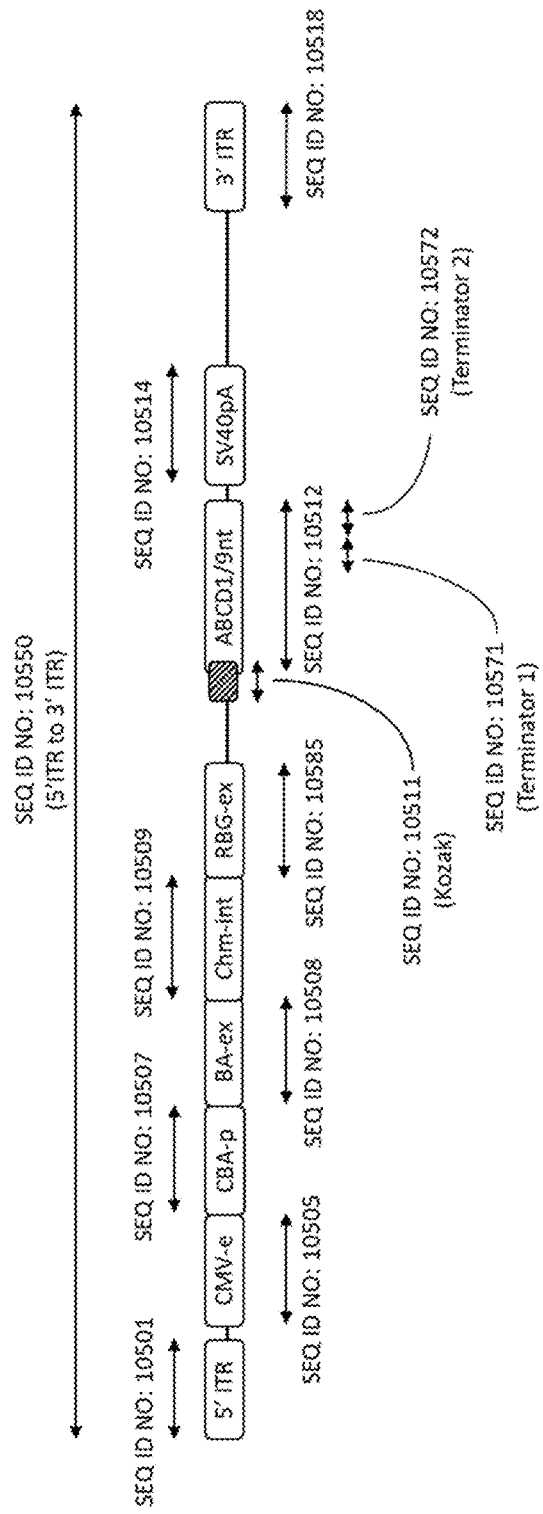
Figure 12E:
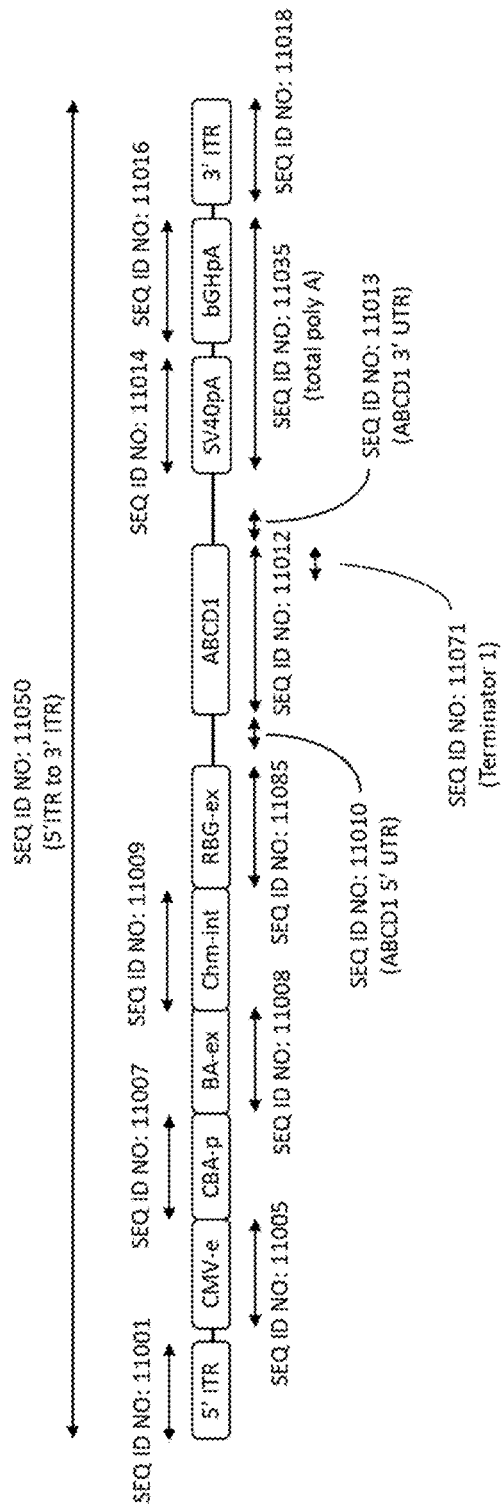
Figure 12F:
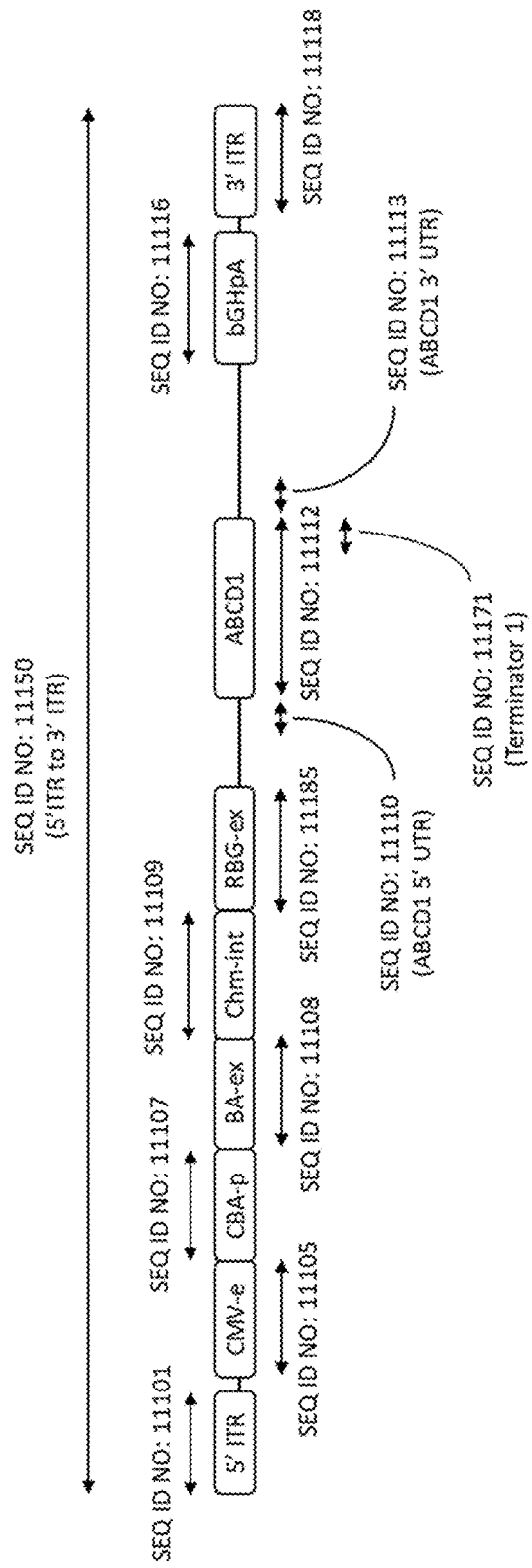
Figure 12G:
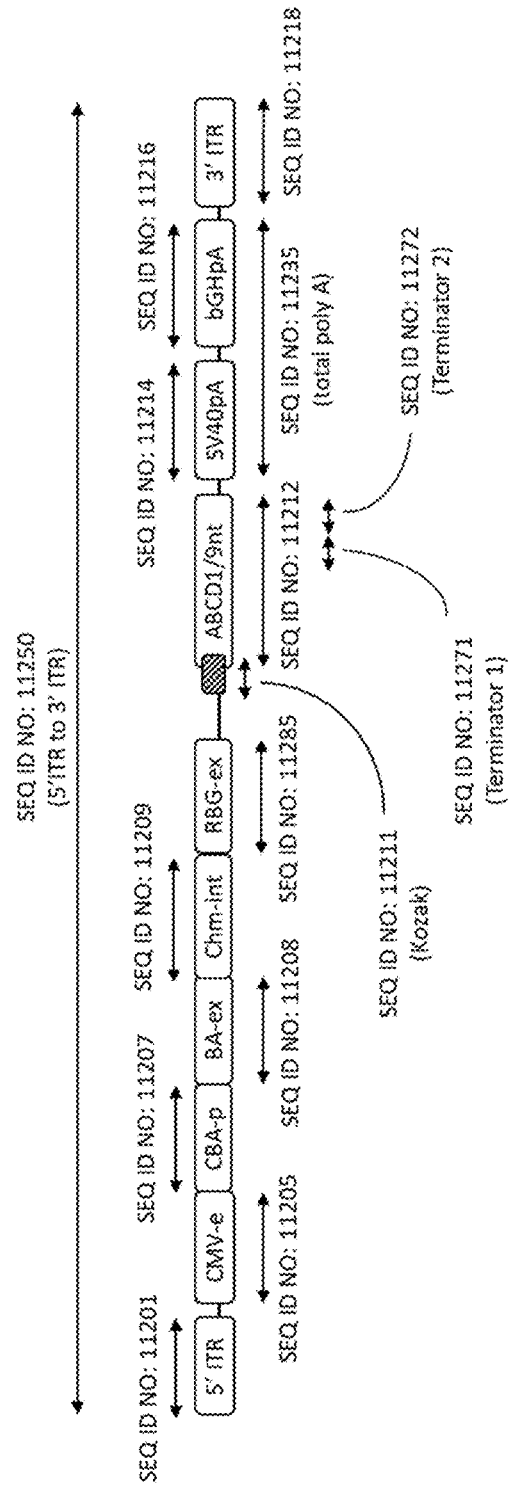
Figure 12H:
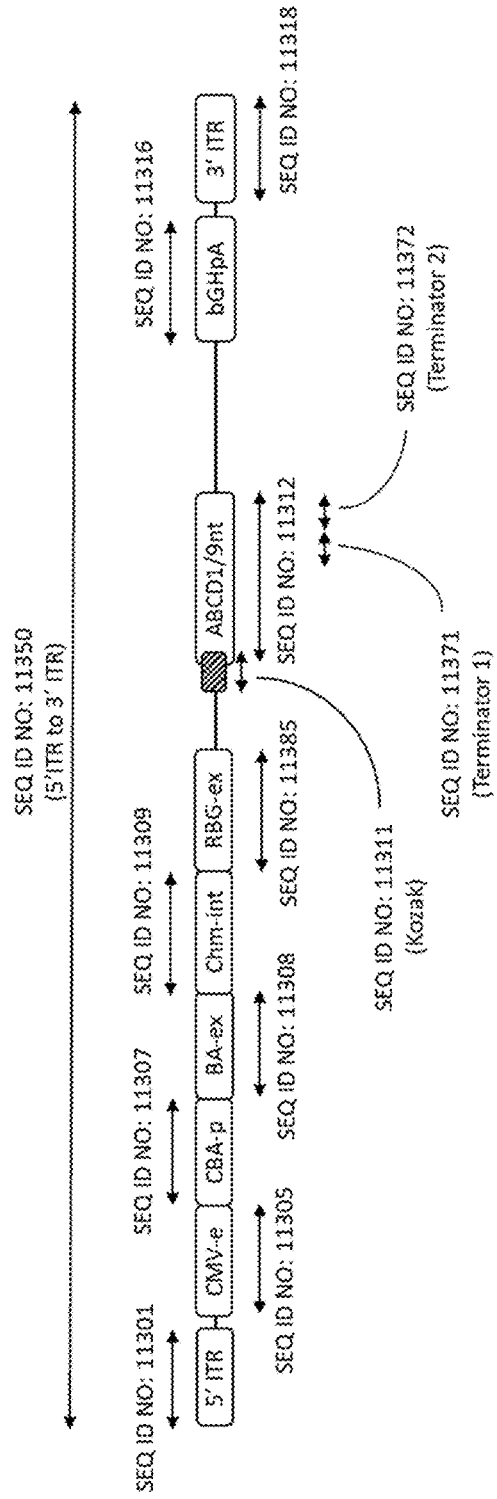
Figure 12I:
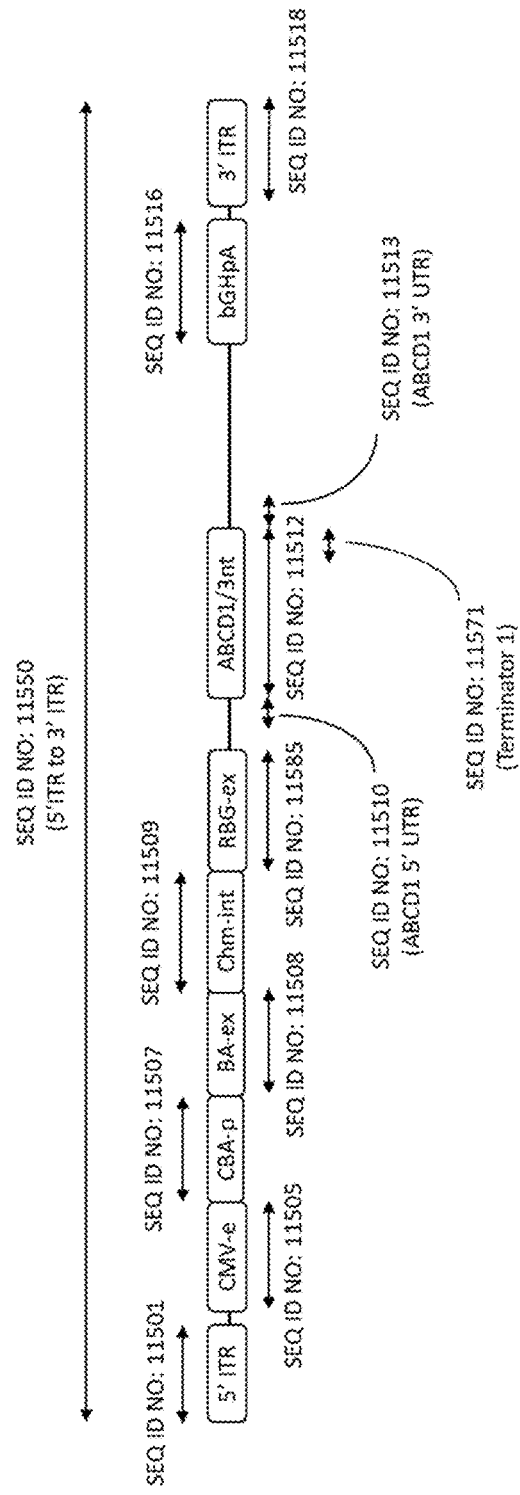
Figure 12J:
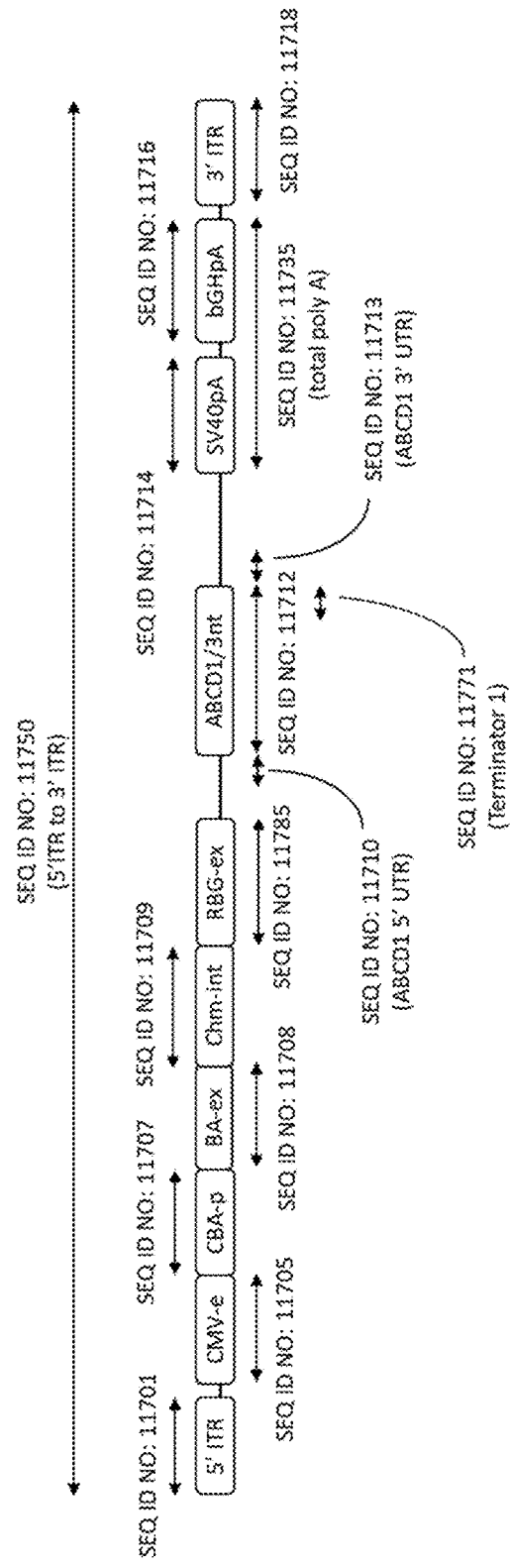

The schematic of the AAV genome (to be packaged in AAV particles) contained in each construct is shown in FIG. 12A. pOB1005, pOB1012, and pOB1013 respectively contain the Kozak sequence immediately before the start codon of ABCD1 and nine mutations within the ABCD1-encoding sequence relative to the wild-type ABCD1-encoding sequence contained in pSBT101. pOB1015 and pOB1017 respectively contain three mutations within the ABCD1-encoding sequence relative to the wild-type ABCD1-enconding sequence contained in pSBT101. pOB1011, pOB1013, and pOB1015 do not have an SV40 poly A signal, while still containing a bGH poly A signal. SEQ ID NOs assigned to full plasmids are indicated in FIG. 12B. All full plasmid sequences are further broken into segments, all of which are named as indicated in FIG. 12B and assigned with SEQ ID NOS. When both SV40 and bGH poly A sequences are present, the sequence from the start of SV40pA to the end of bGHpA was named "total polyA signal" and was assigned with an additional SEQ ID NO. Schematics of individual constructs are also depicted with reference to SEQ ID NOs in FIG. 12C-12J. The sequences referred to in FIGS. 12B and 12C-12J are all included in the Sequence Listing.

Example 8: ABCD1 Protein Expression Comparison

AAV vectors were produced using the new plasmid constructs described in Example 7. Briefly, HEK293 cells were transfected with (1) a rAAV Genome Vector plasmid of interest (pSBT101, pOB1005, pOB1010, pOB1011, pOB1012, pOB1013, pOB1015, or pOB1017) (2) a plasmid encoding the AAV Rep and Cap protein (pAAV2/9 (SEQ ID NO: 700)) and (3) adenovirus helper plasmid (pALD-X80). The rAAV vectors were harvested via CsCl gradient centrifugation, followed by desalting and concentration. The rAAV titers were determined by ddPCR.

Figure 13B:
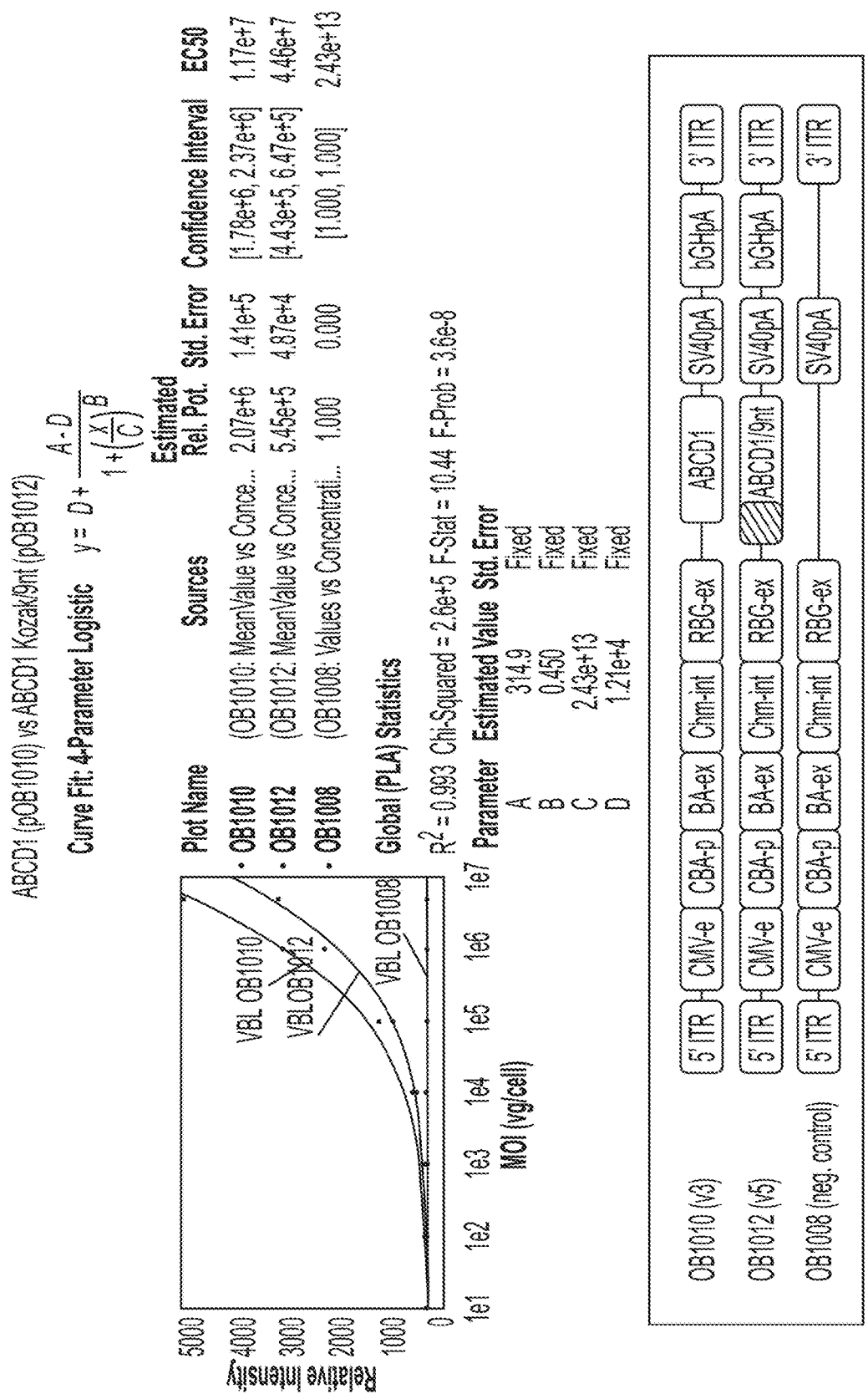
Figure 13C:
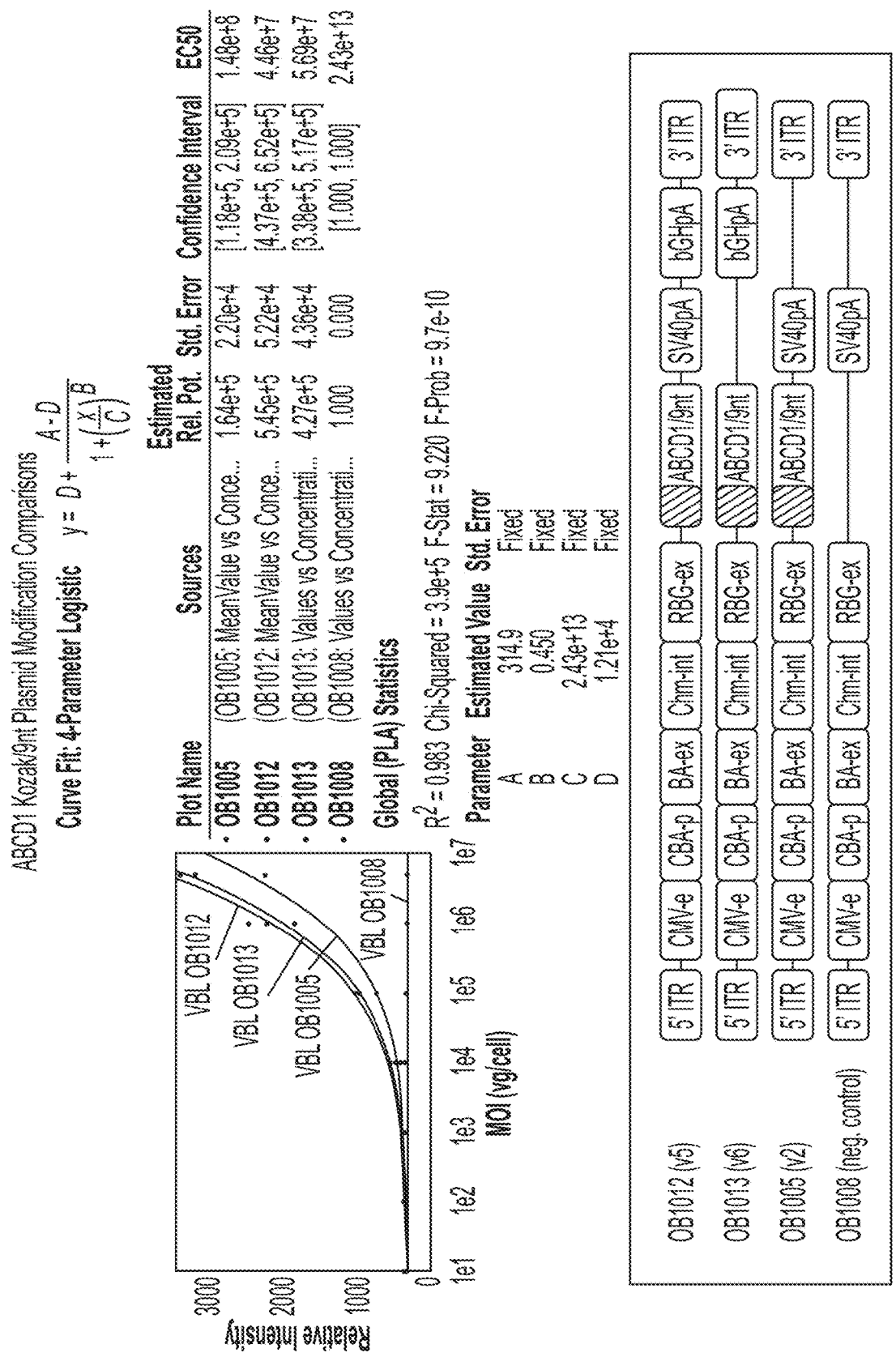
Figure 13E:
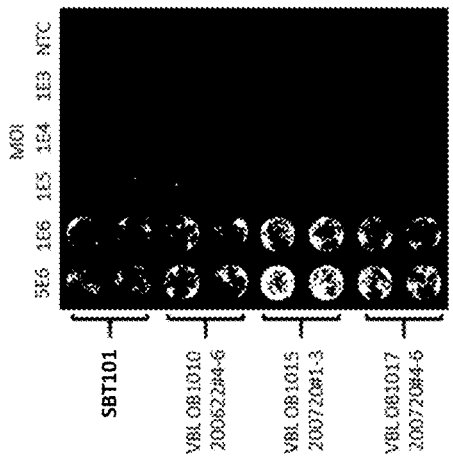

Effects of different plasmid constructs on ABCD1 protein expression were assessed. Briefly, ABCD1 knockout Lec2 cells were transduced with different AAV9-CBA-ABCD1 vectors (AAV vectors SBT101, OB1005, OB1010, OB1011, OB1012, OB1013, OB1015, and OB1017) or the control vector (AAV9-CBA-empty vector "OB1008" generated using the pOB1008 plasmid) at an MOI of $1\times10^3$, $1\times10^4$, $1\times10^5$, $1\times10^6$, and $5\times10^6$ gene copies per cell. 3 days post transduction, ABCD1 protein expression levels were measured by in-cell western blot (ICWB). ABCD1 protein levels were plotted against the MOI and the dose-expression curve was fitted as described in FIGS. 13A-13D. Estimated relative potential (relative to pOB1008 in FIGS. 13A-13C and relative to pSBT101 in FIG. 13D), standard error, 95% confidence interval, and EC50 values for each AAV vector were calculated. FIG. 13E shows exemplary western blot wells and relative intensity data.

As shown in FIGS. 13A-13D, all of the new constructs described in Example 7 (v1-v8) successfully lead to ABCD1 protein expression higher than the level resulting from the control construct (pOB1008). Furthermore, OB1010, OB1015, and OB1017 lead to significantly higher ABCD1 expression compared to pSBT101 (FIGS. 13A and 13D), meaning that pOB1010, pOB1015, and pOB1017 achieved the goal of recovering the ABCD1 expression that was reduced in pSBT101, without using a WPRE. This is particularly surprising and unexpected considering that the expression was recovered without introducing another enhancer in place of the WPRE.

Example 9: VLCFA Reduction Comparison

To test whether AAV vectors that resulted in high ABCD1 expression (OB1010, OB1015, and OB1017) cause reduction in VLCFA, ABCD1 KO Lec2 cells were transduced with AAV vectors OB1010, OB1015, and OB1017 produced as described in Example 8 at an MOI of $1\times10^3$, $1\times10^4$, $1\times10^5$, $1\times10^6$, and $5\times10^6$ gene copies per cell, and VLCFA levels were quantified. As shown in FIG. 14, all of OB1010, OB1015, and OB1017 successfully reduced VLCFA as demonstrated by the reduced C26:0/C22:0 ratio. Interestingly, the VLCFA reduction trend was in accordance with the ABCD1 expression trend (see FIG. 13D), i.e., higher-ABCD1 expressors led to more pronounced VLCFA reduction.

Example 10: Dose Dependency in VLCFA Reduction

To understand the relationship between VLCFA reduction effects and AAV9-CBA-ABCD1 (OB series) doses or ABCD1 expression levels more closely, the rAAV vector OB1010 was used as an example. Two different sets of OB1010 vectors produced by different vendors ("STC" and "VBL") were tested in parallel. rAAV vectors by the two vendors were produced essentially as described in Example 8, but while VBL used ultra-centrifugation for rAAV purification, STC used AAV9 affinity-based purification. Briefly, mixed glial cultures were produced from WT or ABCD1 KO mice. On day 12 post culture, cells from the ABCD1 KO mixed glial cultures were transduced with three different doses (low, mid, and high) of the OB1010 vector. The low, mid, and high doses were $3.3\times10^4$, $1.0\times10^5$, and $5\times10^5$ virus genomes per cell, respectively. WT mixed glial cells were untreated. 5 days post transduction the cells were harvested for VLCFA analysis and ABCD1 protein quantification by Western Blot.

Figure 15A:
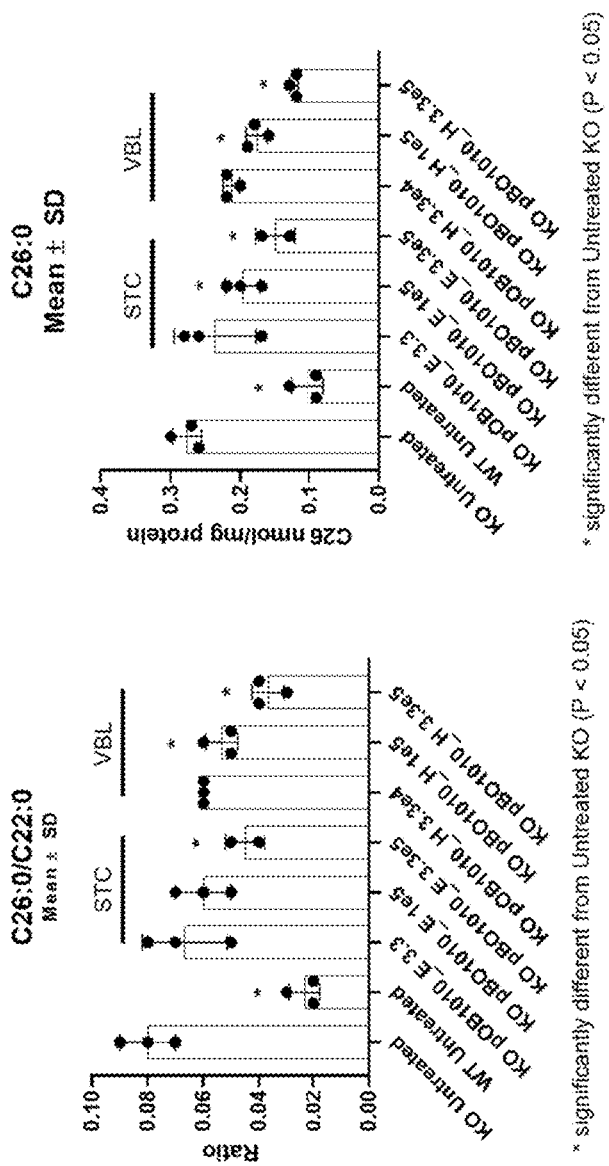
FIGS. 15A-15C provide exemplary dose dependency in reduction of VLCFA in ABCD1 KO mixed glial cells observed in Example 10.
Figure 15B:
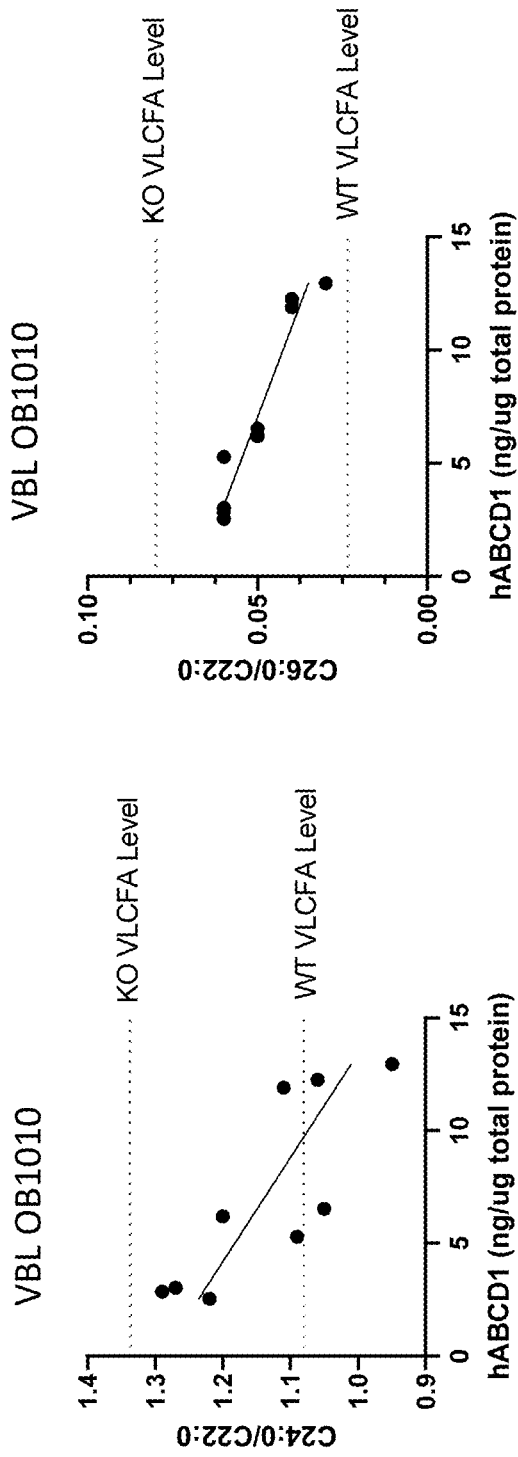

As demonstrated in FIG. 15A, regardless of the vendor, OB1010 reduced both C26:0/C22:0 ratio and C26:0 amounts in a vector dose-dependent manner. When C26:0/C22:0 ratio or C24:0/C22:0 ratio were plotted against the ABCD1 protein expression levels, both reduction in C26:0/C22:0 ratio and in C24:0/C22:0 ratio correlated with increased ABCD1 protein levels, as shown in FIG. 15B.

Figure 15C:
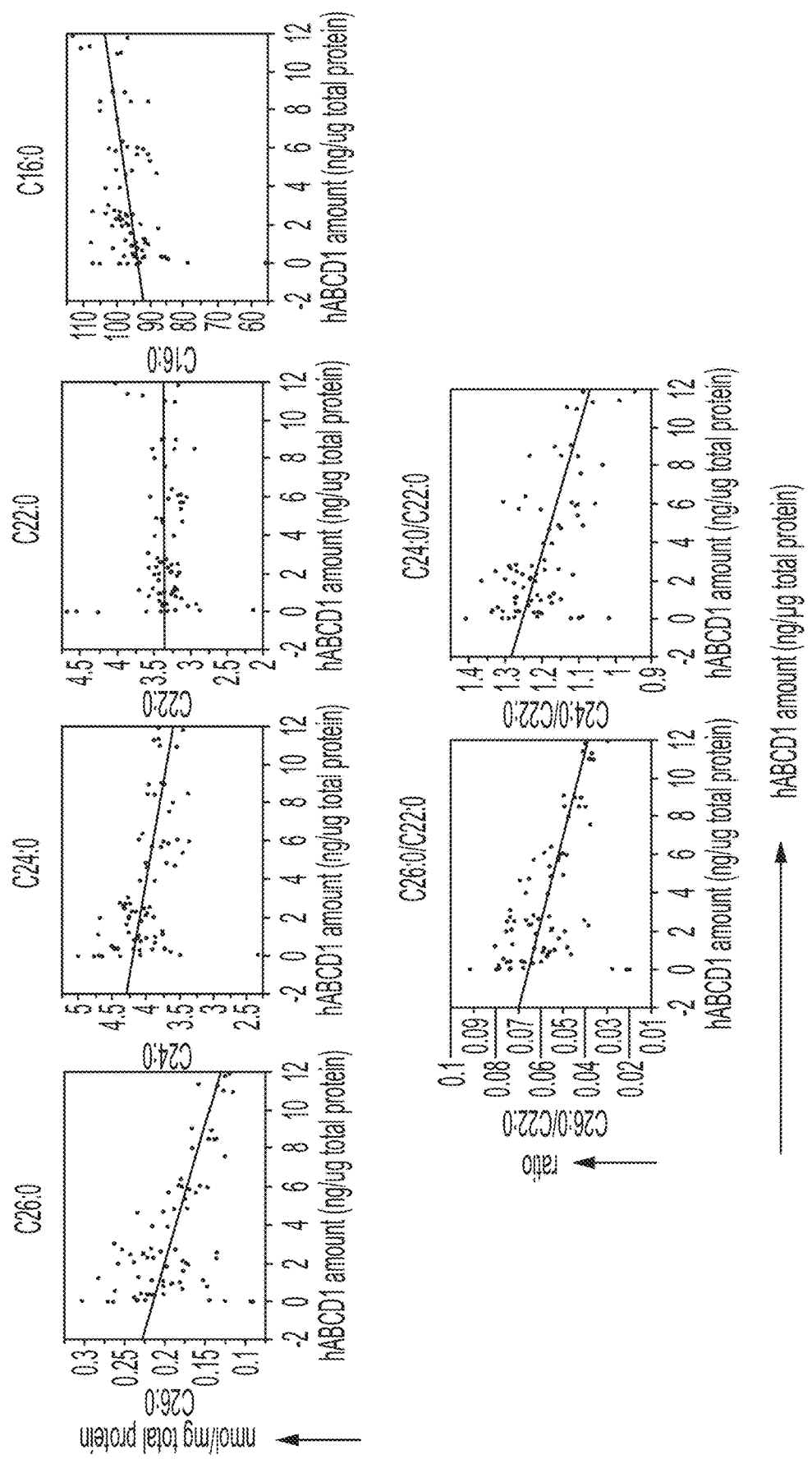

The same experiments were performed using a few other AAV-CBA-ABCD1 vectors such as pOB101011 produced by different vendors, and similar dose- and/or protein level-dependent VLCFA reduction was observed. Relationship between ABCD1 expression and various VLCFA parameters (absolute amount and ratio), in which data from all tested AAV-CBA-ABCD1 vectors from different vendors are combined, is summarized in FIG. 15C. As shown in the top four graphs in FIG. 15C, increased ABCD1 levels were associated with lower VLCFA (C26:0 and C24:0) and higher shorter fatty acid (C16:0), while C22:0 did not seem to be influenced by ABCD1 expression. When the fatty acid ratios were plotted against ABCD1 protein expression, increased ABCD1 levels were associated with lower C26:0/C22:0 and C24:0/C22:0 ratios, as shown in the bottom two graphs in FIG. 15C.

Example 11: In Vivo Effects Elicited by SBT101

To test whether AAV9-CBA-ABCD1 vectors can restore ABCD1 expression to reduce VLCFA in vivo, ABCD1 KO mice were intrathecally administered with various amounts of the rAAV SBT101 produced as described in Example 8. The administration doses were low, mid, high, which were $6.1 \times 10^8$ vector genome copies (vg), $1.8 \times 10^9$ vg, and $6.1 \times 10^9$ vg, respectively, as determined by ddPCR. Untreated WT control was also included. Eight weeks post administration, spinal cords were collected. The vector and diploid genomes and mitochondrial DNA (mtDNA) were quantified by ddPCR, and ABCD1 protein levels were quantified by immunoassay coupled to capillary electrophoresis (immuno-CE) using JESS (Protein Simple™).

Figure 16:
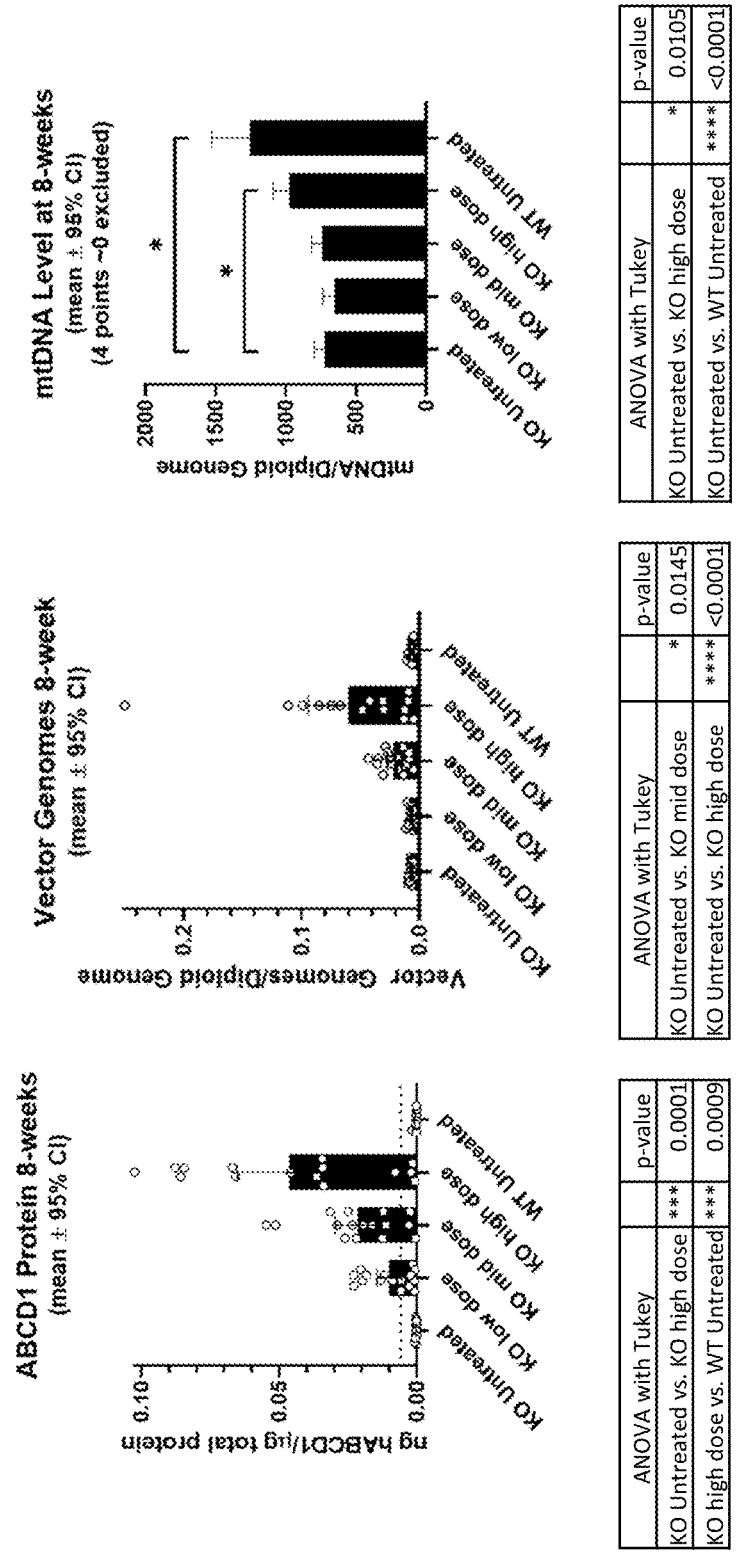
FIG. 16 provides exemplary in vivo effects elicited by SBT101 observed in Example 11. Provided are the rAAV dose-dependent vector genome levels in spinal cord (left) dose-dependent ABCD1 protein expression in spinal cord (middle), and dose-dependent recovery of mitochondrial DNA (mtDNA) levels in spinal cord (right). Recovery of mtRNA levels is a surrogate marker for recovery of VLCLA beta-oxidation.

Results are summarized in FIG. 16. As shown in the left and middle graphs, dose-dependent vector genome levels and dose-dependent ABCD1 protein expression were confirmed. Regarding the mtDNA, mtDNA is a proxy for the number of mitochondria and mtDNA is reduced in ABCD1 knockout mice compared to wild-type mice, as shown in the right graph. Without wishing to be bound by theory, reduced mtDNA in ABCD1 KO is suggested to be linked to reduced beta-oxidation of VLCFA in the peroxisome, and therefore an increase or recovery in the mtDNA levels is a surrogate marker of an increase or recovery in beta-oxidation of VLCFA. As demonstrated in the right graph, mtDNA levels recovered in a vector dose-dependent manner, and particularly the highest dose provided significant increase in mtDNA relative to untreated and replenished approximately half of mtDNA that was lost by ABCD1 gene knockout. Therefore, it is concluded that the ABCD1-encoding AAV vector without an WPRE successfully expressed ABCD1 sufficiently in glial cells to recover VLCFA transportation into peroxisomes for beta-oxidation in vivo.

Example 12: rAAV Vector Packageability Comparison

To test if pOB1010 provides efficient rAAV vector packaging, pOB1010, pSBT101, and pOB1008 plasmids were compared.

HEK293 cells were transfected with (1) a rAAV Genome Vector plasmid of interest (pSBT101, pOB1010, or pOB1008), (2) an AAV Rep/Cap plasmid (pAAV2/9 (SEQ ID NO: 700), and (3) an adenovirus helper plasmid (pALD-X80). rAAV vectors were harvested via CsCl gradient centrifugation, followed by desalting and concentration. The same amounts (copies) of the genome vector plasmids were used for each AAV vector and the same amounts (copies) of the Rep/Cap plasmid and the adenovirus helper plasmids were used for each AAV vector. The resulting virus titers were compared by ddPCR on the hABCD1 gene (or on the SV40 polyA in the case of pOB1008) and by qPCR on the CMV enhancer gene. These results are summarized in FIG. 17.

In the preceding procedures, various methods and materials have been described. It will, however, be evident that various modifications and changes may be made thereto, and additional procedures may be implemented, without departing from the broader scope of the exemplary procedures as set forth in the claims that follow.

EQUIVALENTS AND SCOPE

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

Furthermore, the invention encompasses all variations, combinations, and permutations in which one or more limitations, elements, clauses, and descriptive terms from one or more of the listed claims is introduced into another claim. For example, any claim that is dependent on another claim can be modified to include one or more limitations found in any other claim that is dependent on the same base claim. Where elements are presented as lists, e.g., in Markush group format, each subgroup of the elements is also disclosed, and any element(s) can be removed from the group. It should it be understood that, in general, where the invention, or aspects of the invention, is/are referred to as comprising particular elements and/or features, certain embodiments of the invention or aspects of the invention consist, or consist essentially of, such elements and/or features. For purposes of simplicity, those embodiments have not been specifically set forth in haec verba herein.

It is also noted that the terms "comprising" and "containing" are intended to be open and permits the inclusion of additional elements or steps. Where ranges are given, endpoints are included. Furthermore, unless otherwise indicated or otherwise evident from the context and understanding of one of ordinary skill in the art, values that are expressed as ranges can assume any specific value or sub-range within the stated ranges in different embodiments of the invention, to the tenth of the unit of the lower limit of the range, unless the context clearly dictates otherwise.

This application refers to various issued patents, published patent applications, journal articles, and other publications, all of which are incorporated herein by reference. If there is a conflict between any of the incorporated references and the instant specification, the specification shall control. In addition, any particular embodiment of the present invention that falls within the prior art may be explicitly excluded from any one or more of the claims. Because such embodiments are deemed to be known to one of ordinary skill in the art, they may be excluded even if the exclusion is not set forth explicitly herein. Any particular embodiment of the invention can be excluded from any claim, for any reason, whether or not related to the existence of prior art.

Those skilled in the art will recognize or be able to ascertain using no more than routine experimentation many equivalents to the specific embodiments described herein. The scope of the present embodiments described herein is

SEQUENCE LISTING (11785 sequences)

SEQ ID NO: 1 - DNA, 2276 bp, Artificial Sequence
  Full, nt 1133-3408 of pOB1005 full plasmid as defined in US62/955667
attgggatagcttccaccatgccggtgctctctaggccccggccctggcgggggaacacgctgaagcgcacggccgtgctcctggccctcgcggcctatggagcccacaaagtctaccccttggtgcgccagtgcctggccccggctaggggtcttcaggcgcccgccggggagcccacgcaggaggcctccggggtcgcggcggccaaagctggcatgaaccgggtattcctgcagcggctcctctggctcctgcggctgctgttcccccgggtcctctgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgcggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctctggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgataactcgagctagcggccgc

SEQ ID NO: 2 - DNA, 149 bp, Artificial Sequence
  AAV2 ITR, nt 1-149 of pOB1005 full plasmid as defined in US62/955667
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgc

SEQ ID NO: 3 - DNA, 50 bp, Artificial Sequence
  Primer TGp_10, nt 19-68 of pOB1005 full plasmid as defined in US62/955667
ctcgctcgctcactgaggccgcccgggcaaagcccgggcgtcgggcgacc

SEQ ID NO: 4 - DNA, 50 bp, Artificial Sequence
  Primer TGp_11, Complement of nt 19-68 of pOB1005 full plasmid as defined in US62/955667
ggtcgcccgacgcccgggctttgcccgggcggcctcagtgagcgagcgag

SEQ ID NO: 5 - DNA, 18 bp, Artificial Sequence
  Primer TGp_14, nt 39-56 of pOB1005 full plasmid as defined in US62/955667
gcccgggcaaagcccggg

SEQ ID NO: 6 - DNA, 21 bp, Artificial Sequence
  Primer TGp_11, nt 79-99 of pOB1005 full plasmid as defined in US62/955667
cggcctcagtgagcgagcgag

SEQ ID NO: 7 - DNA, 304 bp, Artificial Sequence
  CMV enhancer, nt 217-520 of pOB1005 full plasmid as defined in US62/955667
cgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatg

SEQ ID NO: 8 - DNA, 22 bp, Artificial Sequence
  Primer TGp_09, Complement of nt 312-333 of pOB1005 full plasmid as defined in US62/955667
cgtcaatggaaagtccctattg

SEQ ID NO: 9 - DNA, 25 bp, Artificial Sequence
  Primer TGp_13, Complement of nt 389-413 of pOB1005 full plasmid as defined in US62/955667
caatagggggcgtacttggcatatg

SEQ ID NO: 10 - DNA, 278 bp, Artificial Sequence
  chicken beta-actin promoter, nt 522-799 of pOB1005 full plasmid as defined in US62/955667
tcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcg

SEQ ID NO: 11 - DNA, 93 bp, Artificial Sequence
  beta actin exon, nt 800-892 of pOB1005 full plasmid as defined in US62/955667
ggagtcgctgcgcgctgccttcgccccgtgccccgctccgccgccgcctcgcgccgcccgccccggctctgactgaccgcgttactcccacag

SEQ ID NO: 12 - DNA, 231 bp, Artificial Sequence
  chimeric intron, nt 893-1123 of pOB1005 full plasmid as defined in US62/955667
gtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttca

SEQ ID NO: 13 - DNA, 5 bp, Artificial Sequence
  KOZAK, 1146..1150 of pOB1005 full plasmid as defined in US62/955667
ccacc

SEQ ID NO: 14 - DNA, 2235 bp, Artificial Sequence
  hABCD1 cleaned up, nt 1151-3385 of pOB1005 full plasmid as defined in US62/955667
atgccggtgctctctaggccccggccctggcgggggaacacgctgaagcgcacggccgtgctcctggccctcgcggcctatggagcccacaaagtctaccccttggtgcgccagtgcctggccccggctaggggtcttcaggcgcccgccggggagcccacgcaggaggcctccggggtcgcggcggccaaagctggcatgaaccgggtattcctgcagcggctcctctggctcctgcggctgctgttcccccgggtcctctgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgcggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctctggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacc

SEQ ID NO: 15 - DNA, 20 bp, Artificial Sequence
  Primer 5 Fwd, nt 2148-2167 of pOB1005 full plasmid as defined in US62/955667
tcctcatgaagtatgtgtgg

SEQ ID NO: 16 - DNA, 20 bp, Artificial Sequence
  Primer 2 Fwd, nt 2151-2170 of pOB1005 full plasmid as defined in US62/955667
tcatgaagtatgtgtggagc

SEQ ID NO: 17 - DNA, 20 bp, Artificial Sequence
  Primer 4 Fwd, nt 2294-2313 of pOB1005 full plasmid as defined in US62/955667
acagaagccttcactattgc

SEQ ID NO: 18 - DNA, 19 bp, Artificial Sequence
  primer Brammer Rev, Complement of nt 2307-2325 of pOB1005 full plasmid as defined in US62/955667
aggaggttgcgggcaatag

SEQ ID NO: 19 - DNA, 20 bp, Artificial Sequence
  Primer 2 Rev, Complement of nt 2408-2427 of pOB1005 full plasmid as defined in US62/955667
aatacctggaacatctcgtg

SEQ ID NO: 20 - DNA, 20 bp, Artificial Sequence
  Primer 4 Rev, Complement of nt 2408-2427 of pOB1005 full plasmid as defined in US62/955667
aatacctggaacatctcgtg

SEQ ID NO: 21 - DNA, 20 bp, Artificial Sequence
  Primer 5 Rev, Complement of nt 2408-2427 of pOB1005 full plasmid as defined in US62/955667
aatacctggaacatctcgtg

SEQ ID NO: 22 - DNA, 20 bp, Artificial Sequence
  CDS primer probe Fwd, nt 2940-2959 of pOB1005 full plasmid as defined in US62/955667
ctatgtgtgactggaaggac

SEQ ID NO: 23 - DNA, 20 bp, Artificial Sequence
  Primer 3 Fwd, nt 2940-2959 of pOB1005 full plasmid as defined in US62/955667
ctatgtgtgactggaaggac

SEQ ID NO: 24 - DNA, 20 bp, Artificial Sequence
  CDS primer probe Rev, Complement of nt 3142-3161 of pOB1005 full plasmid as defined in US62/955667
gcaagtgtgtgtggtatttc

SEQ ID NO: 25 - DNA, 20 bp, Artificial Sequence
  Primer 3 Rev, Complement of nt 3153-3172 of pOB1005 full plasmid as defined in US62/955667
atcgaactgtagcaagtgtg

SEQ ID NO: 26 - DNA, 20 bp, Artificial Sequence
  Primer TGp_19, nt 3250-3269 of pOB1005 full plasmid as defined in US62/955667
gcagcagctggcgggcattc

SEQ ID NO: 27 - DNA, 132 bp, Artificial Sequence
  SV40 polyadenylation signal, nt 3419-3550 of pOB1005 full plasmid as defined in US62/955667
gatccagacatgataagatacattgatgagtttggacaaaccacaactagaatgcagtgaaaaaaatgctttatttgtgaaatttgtgatgctattgctttatttgtaaccattataagctgcaataaacaa

SEQ ID NO: 28 - DNA, 141 bp, Artificial Sequence
  AAV2 ITR, nt 3573-3713 of pOB1005 full plasmid as defined in US62/955667
aggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 29 - DNA, 50 bp, Artificial Sequence; identical to SEQ ID NO: 4
  Primer TGp_11, Complement of nt 3615-3635 of pOB1005 full plasmid as defined in US62/955667

SEQ ID NO: 30 - DNA, 50 bp, Artificial Sequence; identical to SEQ ID NO: 3
  Primer TGp_10, Complement of nt 3646-3695 of pOB1005 full plasmid as defined in US62/955667

SEQ ID NO: 31 - DNA, 50 bp, Artificial Sequence; identical to SEQ ID NO: 4
  Primer TGp_11, nt 3646-3695 of pOB1005 full plasmid as defined in US62/955667

SEQ ID NO: 32 - DNA, 18 bp, Artificial Sequence
  Primer TGp_14, Complement of nt 3658-3675 of pOB1005 full plasmid as defined in US62/955667
gcccgggcaaagcccggg

SEQ ID NO: 33 - DNA, 456 bp, Artificial Sequence
  f1 bacteriophage origin of replication, nt 3788-4243 of pOB1005 full plasmid as defined in US62/955667
acgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattt

SEQ ID NO: 34 - DNA, 20 bp, Artificial Sequence
  Primer TGp_17, Complement of nt 3915-3934 of pOB1005 full plasmid as defined in US62/955667
gagcttgacggggaaagccg

SEQ ID NO: 35 - DNA, 18 bp, Artificial Sequence
  Primer TGp_07, nt 4330-4347 of pOB1005 full plasmid as defined in US62/955667
cgggcttgtctgctcccg

SEQ ID NO: 36 - DNA, 105 bp, Artificial Sequence
  BLA promoter, nt 4478-4582 of pOB1005 full plasmid as defined in US62/955667
cgcggaacccctatttgtttatttttctaaatacattcaaatatgtatccgctcatgagacaataaccctgataaatgcttcaataatattgaaaaaggaagagt

SEQ ID NO: 37 - DNA, 816 bp, Artificial Sequence
  KanR, nt 4583-5398 of pOB1005 full plasmid as defined in US62/955667
atgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccctgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaa

SEQ ID NO: 38 - DNA, 23 bp, Artificial Sequence
  nt 4652-4674 of pOB1005 full plasmid as defined in US62/955667
tatgggtataaatgggctcgcga

SEQ ID NO: 39 - DNA, 589 bp, Artificial Sequence
  high-copy-number ColE1/pMB1/pBR322/pUC origin of replication, nt 5475-6063 of pOB1005 full plasmid as defined in US62/955667
ttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaa

SEQ ID NO: 40 - DNA, 19 bp, Artificial Sequence
  Primer TGp_08, Complement of 5550-5568 of pOB1005 full plasmid as defined in US62/955667
tggtagctcttgatccggc

SEQ ID NO: 41 - DNA, 21 bp, Artificial Sequence
  Primer TGp_05, nt 5942-5962 of pOB1005 full plasmid as defined in US62/955667
agcgcacgagggagcttccag

SEQ ID NO: 42-99 - skipped (58 entries)

SEQ ID NO: 100 - DNA, 6124 bp, Artificial Sequence
  pOB1005 full plasmid
cctgcaggcagctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctcgcgtattgggatagcttccaccatgccggtgctctctaggccccggccctggcgggggaacacgctgaagcgcacggccgtgctcctggccctcgcggcctatggagcccacaaagtctaccccttggtgcgccagtgcctggccccggctaggggtcttcaggcgcccgccggggagcccacgcaggaggcctccggggtcgcggcggccaaagctggcatgaaccgggtattcctgcagcggctcctctggctcctgcggctgctgttcccccgggtcctctgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgcggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctctggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgataactcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgacgcggaacccctatttgtttatttttctaaatacattcaaatatgtatccgctcatgagacaataaccctgataaatgcttcaataatattgaaaaaggaagagtatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccctgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 101-199 - skipped (99 entries)

SEQ ID NO: 200 - DNA, 4589 bp, Artificial Sequence
  AAV-CBA-hABCD1-WPRE, ITR-ITR Entire Construct
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctgaattcggtaccctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagcttatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgactcgagctagcggccgctctagaagataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggactagagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggcca

SEQ ID NO: 201 - DNA, 149 bp, Artificial Sequence
  AAV-CBA-hABCD1-WPRE, 5' ITR
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagat

SEQ ID NO: 202 - DNA, 139 bp, Artificial Sequence
  AAV-CBA-hABCD1-WPRE, 3' ITR
cccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggcca

SEQ ID NO: 203 - DNA, 983 bp, Artificial Sequence
  AAV-CBA-hABCD1-WPRE, Hybrid promoter (CMV immediate early enhancer, chicken beta-actin promoter, beta-actin exon, chimeric intron)
ctgaattcggtaccctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttca

SEQ ID NO: 204 - DNA, 2238 bp, Artificial Sequence
  AAV-CBA-hABCD1-WPRE, hABCD1 cDNA
atgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctga

SEQ ID NO: 205 - DNA, 602 bp, Artificial Sequence
  AAV-CBA-hABCD1-WPRE, WPRE
gataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggactag

SEQ ID NO: 206 - DNA, 434 bp, Artificial Sequence
  AAV-CBA-hABCD1-WPRE, polyA (SV40 polyA and BGH polyA immediately following)
gatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctgggga

SEQ ID NO: 207-299 - skipped (93 entries)

SEQ ID NO: 300 - DNA, 4589 bp, Artificial Sequence
  AAV-CBA-hABCD1-WPREXinact, ITR-ITR Entire Construct
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctgaattcggtaccctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagcttatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgactcgagctagcggccgctctagaagataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggactagagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggcca

SEQ ID NO: 301 - DNA, 149 bp, Artificial Sequence; identical to SEQ ID NO: 201
  AAV-CBA-hABCD1-WPREXinact, 5' ITR (alternative definition)

SEQ ID NO: 302 - DNA, 139 bp, Artificial Sequence; identical to SEQ ID NO: 202
  AAV-CBA-hABCD1-WPREXinact, 3' ITR (alternative definition)

SEQ ID NO: 303 - DNA, 983 bp, Artificial Sequence; identical to SEQ ID NO: 203
  AAV-CBA-hABCD1-WPREXinact, Hybrid promoter (CMV immediate early enhancer, chicken beta-actin promoter, beta-actin exon, chimeric intron)

SEQ ID NO: 304 - DNA, 2238 bp, Artificial Sequence; identical to SEQ ID NO: 204
  AAV-CBA-hABCD1-WPREXinact, hABCD1 cDNA

SEQ ID NO: 305 - DNA, 601 bp, Artificial Sequence
  AAV-CBA-hABCD1-WPREXinact, WPRE (X inact) (SEQ ID NO: 305)
gataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggacta

SEQ ID NO: 306 - DNA, 434 bp, Artificial Sequence; identical to SEQ ID NO: 206
  AAV-CBA-hABCD1-WPREXinact, polyA (SV40 polyA and BGH polyA immediately following)

SEQ ID NO: 307-399 - skipped (93 entries)

SEQ ID NO: 400 - DNA, 3982 bp, Artificial Sequence
  AAV-CBA-hABCD1 [no WPRE], 5' ITR - 3'ITR Entire Construct
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctgaattcggtaccctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgactcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggcca

SEQ ID NO: 401 - DNA, 149 bp, Artificial Sequence; identical to SEQ ID NO: 201
  AAV-CBA-hABCD1, 5' ITR (alternative definition)

SEQ ID NO: 402 - DNA, 139 bp, Artificial Sequence; identical to SEQ ID NO: 202
  AAV-CBA-hABCD1, 3' ITR (alternative definition)

SEQ ID NO: 403 - DNA, 983 bp, Artificial Sequence; identical to SEQ ID NO: 203
  AAV-CBA-hABCD1, Hybrid promoter (CMV immediate early enhancer, chicken beta-actin promoter, beta-actin exon, chimeric intron)

SEQ ID NO: 404 - DNA, 2238 bp, Artificial Sequence; identical to SEQ ID NO: 204
  AAV-CBA-hABCD1, hABCD1 cDNA

SEQ ID NO: 405 - DNA, 434 bp, Artificial Sequence; identical to SEQ ID NO: 206
  AAV-CBA-hABCD1, polyA (SV40 polyA and BGH polyA immediately following)

SEQ ID NO: 406-500 - skipped (95 entries)

SEQ ID NO: 501 - DNA, 2235 bp, Artificial Sequence
  Exemplary ABCD1 coding sequence 01
atgcccgtgctgagcagacccagaccctggagaggcaacaccctgaagagaaccgccgtgctgctggccctggccgcctacggcgcccacaaggtgtaccccctggtgagacagtgcctggcccccgccagaggcctgcaggcccccgccggcgagcccacccaggaggccagcggcgtggccgccgccaaggccggcatgaacagagtgttcctgcagagactgctgtggctgctgagactgctgttccccagagtgctgtgcagagagaccggcctgctggccctgcacagcgccgccctggtgagcagaaccttcctgagcgtgtacgtggccagactggacggcagactggccagatgcatcgtgagaaaggaccccagagccttcggctggcagctgctgcagtggctgctgatcgccctgcccgccaccttcgtgaacagcgccatcagatacctggagggccagctggccctgagcttcagaagcagactggtggcccacgcctacagactgtacttcagccagcagacctactacagagtgagcaacatggacggcagactgagaaaccccgaccagagcctgaccgaggacgtggtggccttcgccgccagcgtggcccacctgtacagcaacctgaccaagcccctgctggacgtggccgtgaccagctacaccctgctgagagccgccagaagcagaggcgccggcaccgcctggcccagcgccatcgccggcctggtggtgttcctgaccgccaacgtgctgagagccttcagccccaagttcggcgagctggtggccgaggaggccagaagaaagggcgagctgagatacatgcacagcagagtggtggccaacagcgaggagatcgccttctacggcggccacgaggtggagctggccctgctgcagagaagctaccaggacctggccagccagatcaacctgatcctgctggagagactgtggtacgtgatgctggagcagttcctgatgaagtacgtgtggagcgccagcggcctgctgatggtggccgtgcccatcatcaccgccaccggctacagcgagagcgacgccgaggccgtgaagaaggccgccctggagaagaaggaggaggagctggtgagcgagagaaccgaggccttcaccatcgccagaaacctgctgaccgccgccgccgacgccatcgagagaatcatgagcagctacaaggaggtgaccgagctggccggctacaccgccagagtgcacgagatgttccaggtgttcgaggacgtgcagagatgccacttcaagagacccagagagctggaggacgcccaggccggcagcggcaccatcggcagaagcggcgtgagagtggagggccccctgaagatcagaggccaggtggtggacgtggagcagggcatcatctgcgagaacatccccatcgtgacccccagcggcgaggtggtggtggccagcctgaacatcagagtggaggagggcatgcacctgctgatcaccggccccaacggctgcggcaagagcagcctgttcagaatcctgggcggcctgtggcccacctacggcggcgtgctgtacaagccccccccccagagaatgttctacatcccccagagaccctacatgagcgtgggcagcctgagagaccaggtgatctaccccgacagcgtggaggacatgcagagaaagggctacagcgagcaggacctggaggccatcctggacgtggtgcacctgcaccacatcctgcagagagagggcggctgggaggccatgtgcgactggaaggacgtgctgagcggcggcgagaagcagagaatcggcatggccagaatgttctaccacagacccaagtacgccctgctggacgagtgcaccagcgccgtgagcatcgacgtggagggcaagatcttccaggccgccaaggacgccggcatcgccctgctgagcatcacccacagacccagcctgtggaagtaccacacccacctgctgcagttcgacggcgagggcggctggaagttcgagaagctggacagcgccgccagactgagcctgaccgaggagaagcagagactggagcagcagctggccggcatccccaagatgcagagaagactgcaggagctgtgccagatcctgggcgaggccgtggcccccgcccacgtgcccgcccccagcccccagggccccggcggcctgcagggcgccagcacc

SEQ ID NO: 502 - DNA, 2235 bp, Artificial Sequence
  Exemplary ABCD1 coding sequence 02
atgcccgtgctgagcaggcccaggccctggaggggcaacaccctgaagaggaccgccgtgctgctggccctggccgcctacggcgcccacaaggtgtaccccctggtgaggcagtgcctggcccccgccaggggcctgcaggcccccgccggcgagcccacccaggaggccagcggcgtggccgccgccaaggccggcatgaacagggtgttcctgcagaggctgctgtggctgctgaggctgctgttccccagggtgctgtgcagggagaccggcctgctggccctgcacagcgccgccctggtgagcaggaccttcctgagcgtgtacgtggccaggctggacggcaggctggccaggtgcatcgtgaggaaggaccccagggccttcggctggcagctgctgcagtggctgctgatcgccctgcccgccaccttcgtgaacagcgccatcaggtacctggagggccagctggccctgagcttcaggagcaggctggtggcccacgcctacaggctgtacttcagccagcagacctactacagggtgagcaacatggacggcaggctgaggaaccccgaccagagcctgaccgaggacgtggtggccttcgccgccagcgtggcccacctgtacagcaacctgaccaagcccctgctggacgtggccgtgaccagctacaccctgctgagggccgccaggagcaggggcgccggcaccgcctggcccagcgccatcgccggcctggtggtgttcctgaccgccaacgtgctgagggccttcagccccaagttcggcgagctggtggccgaggaggccaggaggaagggcgagctgaggtacatgcacagcagggtggtggccaacagcgaggagatcgccttctacggcggccacgaggtggagctggccctgctgcagaggagctaccaggacctggccagccagatcaacctgatcctgctggagaggctgtggtacgtgatgctggagcagttcctgatgaagtacgtgtggagcgccagcggcctgctgatggtggccgtgcccatcatcaccgccaccggctacagcgagagcgacgccgaggccgtgaagaaggccgccctggagaagaaggaggaggagctggtgagcgagaggaccgaggccttcaccatcgccaggaacctgctgaccgccgccgccgacgccatcgagaggatcatgagcagctacaaggaggtgaccgagctggccggctacaccgccagggtgcacgagatgttccaggtgttcgaggacgtgcagaggtgccacttcaagaggcccagggagctggaggacgcccaggccggcagcggcaccatcggcaggagcggcgtgagggtggagggccccctgaagatcaggggccaggtggtggacgtggagcagggcatcatctgcgagaacatccccatcgtgacccccagcggcgaggtggtggtggccagcctgaacatcagggtggaggagggcatgcacctgctgatcaccggccccaacggctgcggcaagagcagcctgttcaggatcctgggcggcctgtggcccacctacggcggcgtgctgtacaagccccccccccagaggatgttctacatcccccagaggccctacatgagcgtgggcagcctgagggaccaggtgatctaccccgacagcgtggaggacatgcagaggaagggctacagcgagcaggacctggaggccatcctggacgtggtgcacctgcaccacatcctgcagagggagggcggctgggaggccatgtgcgactggaaggacgtgctgagcggcggcgagaagcagaggatcggcatggccaggatgttctaccacaggcccaagtacgccctgctggacgagtgcaccagcgccgtgagcatcgacgtggagggcaagatcttccaggccgccaaggacgccggcatcgccctgctgagcatcacccacaggcccagcctgtggaagtaccacacccacctgctgcagttcgacggcgagggcggctggaagttcgagaagctggacagcgccgccaggctgagcctgaccgaggagaagcagaggctggagcagcagctggccggcatccccaagatgcagaggaggctgcaggagctgtgccagatcctgggcgaggccgtggcccccgcccacgtgcccgcccccagcccccagggccccggcggcctgcagggcgccagcacc

SEQ ID NO: 503 - DNA, 2235 bp, Artificial Sequence
  Exemplary ABCD1 coding sequence 03
atgccagtgttatctcgtccacgtccatggcgtggtaatactttaaaacgtactgcagtgttattagcattagcagcatatggtgcacataaagtgtatccattagtgcgtcaatgtttagcaccagcacgtggtttacaagcaccagcaggtgaaccaactcaagaagcatctggtgtggcagcagcaaaagcaggtatgaatcgtgtgtttttacaacgtttattatggttattacgtttattatttccacgtgtgttatgtcgtgaaactggtttattagcattacattctgcagcattagtgtctcgtacttttttatctgtgtatgtggcacgtttagatggtcgtttagcacgttgtattgtgcgtaaagatccacgtgcatttggttggcaattattacaatggttattaattgcattaccagcaacttttgtgaattctgcaattcgttatttagaaggtcaattagcattatcttttcgttctcgtttagtggcacatgcatatcgtttatatttttctcaacaaacttattatcgtgtgtctaatatggatggtcgtttacgtaatccagatcaatctttaactgaagatgtggtggcatttgcagcatctgtggcacatttatattctaatttaactaaaccattattagatgtggcagtgacttcttatactttattacgtgcagcacgttctcgtggtgcaggtactgcatggccatctgcaattgcaggtttagtggtgtttttaactgcaaatgtgttacgtgcattttctccaaaatttggtgaattagtggcagaagaagcacgtcgtaaaggtgaattacgttatatgcattctcgtgtggtggcaaattctgaagaaattgcattttatggtggtcatgaagtggaattagcattattacaacgttcttatcaagatttagcatctcaaattaatttaattttattagaacgtttatggtatgtgatgttagaacaatttttaatgaaatatgtgtggtctgcatctggtttattaatggtggcagtgccaattattactgcaactggttattctgaatctgatgcagaagcagtgaaaaaagcagcattagaaaaaaaagaagaagaattagtgtctgaacgtactgaagcatttactattgcacgtaatttattaactgcagcagcagatgcaattgaacgtattatgtcttcttataaagaagtgactgaattagcaggttatactgcacgtgtgcatgaaatgtttcaagtgtttgaagatgtgcaacgttgtcattttaaacgtccacgtgaattagaagatgcacaagcaggttctggtactattggtcgttctggtgtgcgtgtggaaggtccattaaaaattcgtggtcaagtggtggatgtggaacaaggtattatttgtgaaaatattccaattgtgactccatctggtgaagtggtggtggcatctttaaatattcgtgtggaagaaggtatgcatttattaattactggtccaaatggttgtggtaaatcttctttatttcgtattttaggtggtttatggccaacttatggtggtgtgttatataaaccaccaccacaacgtatgttttatattccacaacgtccatatatgtctgtgggttctttacgtgatcaagtgatttatccagattctgtggaagatatgcaacgtaaaggttattctgaacaagatttagaagcaattttagatgtggtgcatttacatcatattttacaacgtgaaggtggttgggaagcaatgtgtgattggaaagatgtgttatctggtggtgaaaaacaacgtattggtatggcacgtatgttttatcatcgtccaaaatatgcattattagatgaatgtacttctgcagtgtctattgatgtggaaggtaaaatttttcaagcagcaaaagatgcaggtattgcattattatctattactcatcgtccatctttatggaaatatcatactcatttattacaatttgatggtgaaggtggttggaaatttgaaaaattagattctgcagcacgtttatctttaactgaagaaaaacaacgtttagaacaacaattagcaggtattccaaaaatgcaacgtcgtttacaagaattatgtcaaattttaggtgaagcagtggcaccagcacatgtgccagcaccatctccacaaggtccaggtggtttacaaggtgcatctact

SEQ ID NO: 504 - DNA, 2235 bp, Artificial Sequence
  Exemplary ABCD1 coding sequence 04
atgcccgtgctgtcccgcccccgcccctggcgcggcaacaccctgaagcgcaccgccgtgctgctggccctggccgcctacggcgcccacaaggtgtaccccctggtgcgccagtgcctggcccccgcccgcggcctgcaggcccccgccggcgagcccacccaggaggcctccggcgtggccgccgccaaggccggcatgaaccgcgtgttcctgcagcgcctgctgtggctgctgcgcctgctgttcccccgcgtgctgtgccgcgagaccggcctgctggccctgcactccgccgccctggtgtcccgcaccttcctgtccgtgtacgtggcccgcctggacggccgcctggcccgctgcatcgtgcgcaaggacccccgcgccttcggctggcagctgctgcagtggctgctgatcgccctgcccgccaccttcgtgaactccgccatccgctacctggagggccagctggccctgtccttccgctcccgcctggtggcccacgcctaccgcctgtacttctcccagcagacctactaccgcgtgtccaacatggacggccgcctgcgcaaccccgaccagtccctgaccgaggacgtggtggccttcgccgcctccgtggcccacctgtactccaacctgaccaagcccctgctggacgtggccgtgacctcctacaccctgctgcgcgccgcccgctcccgcggcgccggcaccgcctggccctccgccatcgccggcctggtggtgttcctgaccgccaacgtgctgcgcgccttctcccccaagttcggcgagctggtggccgaggaggcccgccgcaagggcgagctgcgctacatgcactcccgcgtggtggccaactccgaggagatcgccttctacggcggccacgaggtggagctggccctgctgcagcgctcctaccaggacctggcctcccagatcaacctgatcctgctggagcgcctgtggtacgtgatgctggagcagttcctgatgaagtacgtgtggtccgcctccggcctgctgatggtggccgtgcccatcatcaccgccaccggctactccgagtccgacgccgaggccgtgaagaaggccgccctggagaagaaggaggaggagctggtgtccgagcgcaccgaggccttcaccatcgcccgcaacctgctgaccgccgccgccgacgccatcgagcgcatcatgtcctcctacaaggaggtgaccgagctggccggctacaccgcccgcgtgcacgagatgttccaggtgttcgaggacgtgcagcgctgccacttcaagcgcccccgcgagctggaggacgcccaggccggctccggcaccatcggccgctccggcgtgcgcgtggagggccccctgaagatccgcggccaggtggtggacgtggagcagggcatcatctgcgagaacatccccatcgtgaccccctccggcgaggtggtggtggcctccctgaacatccgcgtggaggagggcatgcacctgctgatcaccggccccaacggctgcggcaagtcctccctgttccgcatcctgggcggcctgtggcccacctacggcggcgtgctgtacaagccccccccccagcgcatgttctacatcccccagcgcccctacatgtccgtgggctccctgcgcgaccaggtgatctaccccgactccgtggaggacatgcagcgcaagggctactccgagcaggacctggaggccatcctggacgtggtgcacctgcaccacatcctgcagcgcgagggcggctgggaggccatgtgcgactggaaggacgtgctgtccggcggcgagaagcagcgcatcggcatggcccgcatgttctaccaccgccccaagtacgccctgctggacgagtgcacctccgccgtgtccatcgacgtggagggcaagatcttccaggccgccaaggacgccggcatcgccctgctgtccatcacccaccgcccctccctgtggaagtaccacacccacctgctgcagttcgacggcgagggcggctggaagttcgagaagctggactccgccgcccgcctgtccctgaccgaggagaagcagcgcctggagcagcagctggccggcatccccaagatgcagcgccgcctgcaggagctgtgccagatcctgggcgaggccgtggcccccgcccacgtgcccgccccctccccccagggccccggcggcctgcagggcgcctccacc

SEQ ID NO: 505 - DNA, 2235 bp, Artificial Sequence; identical to SEQ ID NO: 502
  Exemplary ABCD1 coding sequence 05

SEQ ID NO: 506 - DNA, 2235 bp, Artificial Sequence
  Exemplary ABCD1 coding sequence 06
atgccagtgctgagcagaccaagaccatggagaggcaataccctgaagagaaccgccgtgctgctggccctggccgcctacggcgcccacaaggtgtacccactggtgagacagtgcctggccccagccagaggcctgcaggccccagccggcgagccaacccaggaggccagcggcgtggccgccgccaaggccggcatgaatagagtgtttctgcagagactgctgtggctgctgagactgctgtttccaagagtgctgtgcagagagaccggcctgctggccctgcacagcgccgccctggtgagcagaacctttctgagcgtgtacgtggccagactggacggcagactggccagatgcatcgtgagaaaggacccaagagcctttggctggcagctgctgcagtggctgctgatcgccctgccagccacctttgtgaatagcgccatcagatacctggagggccagctggccctgagctttagaagcagactggtggcccacgcctacagactgtactttagccagcagacctactacagagtgagcaatatggacggcagactgagaaatccagaccagagcctgaccgaggacgtggtggcctttgccgccagcgtggcccacctgtacagcaatctgaccaagccactgctggacgtggccgtgaccagctacaccctgctgagagccgccagaagcagaggcgccggcaccgcctggccaagcgccatcgccggcctggtggtgtttctgaccgccaatgtgctgagagcctttagcccaaagtttggcgagctggtggccgaggaggccagaagaaagggcgagctgagatacatgcacagcagagtggtggccaatagcgaggagatcgccttttacggcggccacgaggtggagctggccctgctgcagagaagctaccaggacctggccagccagatcaatctgatcctgctggagagactgtggtacgtgatgctggagcagtttctgatgaagtacgtgtggagcgccagcggcctgctgatggtggccgtgccaatcatcaccgccaccggctacagcgagagcgacgccgaggccgtgaagaaggccgccctggagaagaaggaggaggagctggtgagcgagagaaccgaggcctttaccatcgccagaaatctgctgaccgccgccgccgacgccatcgagagaatcatgagcagctacaaggaggtgaccgagctggccggctacaccgccagagtgcacgagatgtttcaggtgtttgaggacgtgcagagatgccactttaagagaccaagagagctggaggacgcccaggccggcagcggcaccatcggcagaagcggcgtgagagtggagggcccactgaagatcagaggccaggtggtggacgtggagcagggcatcatctgcgagaatatcccaatcgtgaccccaagcggcgaggtggtggtggccagcctgaatatcagagtggaggagggcatgcacctgctgatcaccggcccaaatggctgcggcaagagcagcctgtttagaatcctgggcggcctgtggccaacctacggcggcgtgctgtacaagccaccaccacagagaatgttttacatcccacagagaccatacatgagcgtgggcagcctgagagaccaggtgatctacccagacagcgtggaggacatgcagagaaagggctacagcgagcaggacctggaggccatcctggacgtggtgcacctgcaccacatcctgcagagagagggcggctgggaggccatgtgcgactggaaggacgtgctgagcggcggcgagaagcagagaatcggcatggccagaatgttttaccacagaccaaagtacgccctgctggacgagtgcaccagcgccgtgagcatcgacgtggagggcaagatctttcaggccgccaaggacgccggcatcgccctgctgagcatcacccacagaccaagcctgtggaagtaccacacccacctgctgcagtttgacggcgagggcggctggaagtttgagaagctggacagcgccgccagactgagcctgaccgaggagaagcagagactggagcagcagctggccggcatcccaaagatgcagagaagactgcaggagctgtgccagatcctgggcgaggccgtggccccagcccacgtgccagccccaagcccacagggcccaggcggcctgcagggcgccagcacc

SEQ ID NO: 507 - DNA, 2235 bp, Artificial Sequence
  Exemplary ABCD1 coding sequence 07
atgccggtgctgtcgcgcccgcgcccgtggcgcggcaacaccctgaagcgcaccgccgtgctgctggccctggccgcctacggcgcccacaaggtgtacccgctggtgcgccagtgcctggccccggcccgcggcctgcaggccccggccggcgagccgacccaggaggcctcgggcgtggccgccgccaaggccggcatgaaccgcgtgttcctgcagcgcctgctgtggctgctgcgcctgctgttcccgcgcgtgctgtgccgcgagaccggcctgctggccctgcactcggccgccctggtgtcgcgcaccttcctgtcggtgtacgtggcccgcctggacggccgcctggcccgctgcatcgtgcgcaaggacccgcgcgccttcggctggcagctgctgcagtggctgctgatcgccctgccggccaccttcgtgaactcggccatccgctacctggagggccagctggccctgtcgttccgctcgcgcctggtggcccacgcctaccgcctgtacttctcgcagcagacctactaccgcgtgtcgaacatggacggccgcctgcgcaacccggaccagtcgctgaccgaggacgtggtggccttcgccgcctcggtggcccacctgtactcgaacctgaccaagccgctgctggacgtggccgtgacctcgtacaccctgctgcgcgccgcccgctcgcgcggcgccggcaccgcctggccgtcggccatcgccggcctggtggtgttcctgaccgccaacgtgctgcgcgccttctcgccgaagttcggcgagctggtggccgaggaggcccgccgcaagggcgagctgcgctacatgcactcgcgcgtggtggccaactcggaggagatcgccttctacggcggccacgaggtggagctggccctgctgcagcgctcgtaccaggacctggcctcgcagatcaacctgatcctgctggagcgcctgtggtacgtgatgctggagcagttcctgatgaagtacgtgtggtcggcctcgggcctgctgatggtggccgtgccgatcatcaccgccaccggctactcggagtcggacgccgaggccgtgaagaaggccgccctggagaagaaggaggaggagctggtgtcggagcgcaccgaggccttcaccatcgcccgcaacctgctgaccgccgccgccgacgccatcgagcgcatcatgtcgtcgtacaaggaggtgaccgagctggccggctacaccgcccgcgtgcacgagatgttccaggtgttcgaggacgtgcagcgctgccacttcaagcgcccgcgcgagctggaggacgcccaggccggctcgggcaccatcggccgctcgggcgtgcgcgtggagggcccgctgaagatccgcggccaggtggtggacgtggagcagggcatcatctgcgagaacatcccgatcgtgaccccgtcgggcgaggtggtggtggcctcgctgaacatccgcgtggaggagggcatgcacctgctgatcaccggcccgaacggctgcggcaagtcgtcgctgttccgcatcctgggcggcctgtggccgacctacggcggcgtgctgtacaagccgccgccgcagcgcatgttctacatcccgcagcgcccgtacatgtcggtgggctcgctgcgcgaccaggtgatctacccggactcggtggaggacatgcagcgcaagggctactcggagcaggacctggaggccatcctggacgtggtgcacctgcaccacatcctgcagcgcgagggcggctgggaggccatgtgcgactggaaggacgtgctgtcgggcggcgagaagcagcgcatcggcatggcccgcatgttctaccaccgcccgaagtacgccctgctggacgagtgcacctcggccgtgtcgatcgacgtggagggcaagatcttccaggccgccaaggacgccggcatcgccctgctgtcgatcacccaccgcccgtcgctgtggaagtaccacacccacctgctgcagttcgacggcgagggcggctggaagttcgagaagctggactcggccgcccgcctgtcgctgaccgaggagaagcagcgcctggagcagcagctggccggcatcccgaagatgcagcgccgcctgcaggagctgtgccagatcctgggcgaggccgtggccccggcccacgtgccggccccgtcgccgcagggcccgggcggcctgcagggcgcctcgacc

SEQ ID NO: 508 - DNA, 2235 bp, Artificial Sequence
  Exemplary ABCD1 coding sequence 08
atgcccgtgctgagccgcccccgcccctggcgcggcaacaccctgaagcgcaccgccgtgctgctggccctggccgcctacggcgcccacaaggtgtaccccctggtgcgccagtgcctggcccccgcccgcggcctgcaggcccccgccggcgagcccacccaggaggccagcggcgtggccgccgccaaggccggcatgaaccgcgtgttcctgcagcgcctgctgtggctgctgcgcctgctgttcccccgcgtgctgtgccgcgagaccggcctgctggccctgcacagcgccgccctggtgagccgcaccttcctgagcgtgtacgtggcccgcctggacggccgcctggcccgctgcatcgtgcgcaaggacccccgcgccttcggctggcagctgctgcagtggctgctgatcgccctgcccgccaccttcgtgaacagcgccatccgctacctggagggccagctggccctgagcttccgcagccgcctggtggcccacgcctaccgcctgtacttcagccagcagacctactaccgcgtgagcaacatggacggccgcctgcgcaaccccgaccagagcctgaccgaggacgtggtggccttcgccgccagcgtggcccacctgtacagcaacctgaccaagcccctgctggacgtggccgtgaccagctacaccctgctgcgcgccgcccgcagccgcggcgccggcaccgcctggcccagcgccatcgccggcctggtggtgttcctgaccgccaacgtgctgcgcgccttcagccccaagttcggcgagctggtggccgaggaggcccgccgcaagggcgagctgcgctacatgcacagccgcgtggtggccaacagcgaggagatcgccttctacggcggccacgaggtggagctggccctgctgcagcgcagctaccaggacctggccagccagatcaacctgatcctgctggagcgcctgtggtacgtgatgctggagcagttcctgatgaagtacgtgtggagcgccagcggcctgctgatggtggccgtgcccatcatcaccgccaccggctacagcgagagcgacgccgaggccgtgaagaaggccgccctggagaagaaggaggaggagctggtgagcgagcgcaccgaggccttcaccatcgcccgcaacctgctgaccgccgccgccgacgccatcgagcgcatcatgagcagctacaaggaggtgaccgagctggccggctacaccgcccgcgtgcacgagatgttccaggtgttcgaggacgtgcagcgctgccacttcaagcgcccccgcgagctggaggacgcccaggccggcagcggcaccatcggccgcagcggcgtgcgcgtggagggccccctgaagatccgcggccaggtggtggacgtggagcagggcatcatctgcgagaacatccccatcgtgacccccagcggcgaggtggtggtggccagcctgaacatccgcgtggaggagggcatgcacctgctgatcaccggccccaacggctgcggcaagagcagcctgttccgcatcctgggcggcctgtggcccacctacggcggcgtgctgtacaagccccccccccagcgcatgttctacatcccccagcgcccctacatgagcgtgggcagcctgcgcgaccaggtgatctaccccgacagcgtggaggacatgcagcgcaagggctacagcgagcaggacctggaggccatcctggacgtggtgcacctgcaccacatcctgcagcgcgagggcggctgggaggccatgtgcgactggaaggacgtgctgagcggcggcgagaagcagcgcatcggcatggcccgcatgttctaccaccgccccaagtacgccctgctggacgagtgcaccagcgccgtgagcatcgacgtggagggcaagatcttccaggccgccaaggacgccggcatcgccctgctgagcatcacccaccgccccagcctgtggaagtaccacacccacctgctgcagttcgacggcgagggcggctggaagttcgagaagctggacagcgccgcccgcctgagcctgaccgaggagaagcagcgcctggagcagcagctggccggcatccccaagatgcagcgccgcctgcaggagctgtgccagatcctgggcgaggccgtggcccccgcccacgtgcccgcccccagcccccagggccccggcggcctgcagggcgccagcacc

SEQ ID NO: 509 - DNA, 2235 bp, Artificial Sequence
  Exemplary ABCD1 coding sequence 09
atgcctgttttaagtagacctagaccttggagaggaaatactttaaaaagaactgctgttttattagctttagctgcttatggagctcataaagtttatcctttagttagacaatgcttagctcctgctagaggattacaagctcctgctggagaacctactcaagaagctagtggagttgctgctgctaaagctggaatgaatagagtttttttacaaagattattatggttattaagattattatttcctagagttttatgcagagaaactggattattagctttacatagtgctgctttagttagtagaacttttttaagtgtttatgttgctagattagatggaagattagctagatgcattgttagaaaagatcctagagcttttggatggcaattattacaatggttattaattgctttacctgctacttttgttaatagtgctattagatatttagaaggacaattagctttaagttttagaagtagattagttgctcatgcttatagattatattttagtcaacaaacttattatagagttagtaatatggatggaagattaagaaatcctgatcaaagtttaactgaagatgttgttgcttttgctgctagtgttgctcatttatatagtaatttaactaaacctttattagatgttgctgttactagttatactttattaagagctgctagaagtagaggagctggaactgcttggcctagtgctattgctggattagttgtttttttaactgctaatgttttaagagcttttagtcctaaatttggagaattagttgctgaagaagctagaagaaaaggagaattaagatatatgcatagtagagttgttgctaatagtgaagaaattgctttttatggaggacatgaagttgaattagctttattacaaagaagttatcaagatttagctagtcaaattaatttaattttattagaaagattatggtatgttatgttagaacaatttttaatgaaatatgtttggagtgctagtggattattaatggttgctgttcctattattactgctactggatatagtgaaagtgatgctgaagctgttaaaaaagctgctttagaaaaaaaagaagaagaattagttagtgaaagaactgaagcttttactattgctagaaatttattaactgctgctgctgatgctattgaaagaattatgagtagttataaagaagttactgaattagctggatatactgctagagttcatgaaatgtttcaagtttttgaagatgttcaaagatgccattttaaaagacctagagaattagaagatgctcaagctggaagtggaactattggaagaagtggagttagagttgaaggacctttaaaaattagaggacaagttgttgatgttgaacaaggaattatttgcgaaaatattcctattgttactcctagtggagaagttgttgttgctagtttaaatattagagttgaagaaggaatgcatttattaattactggacctaatggatgcggaaaaagtagtttatttagaattttaggaggattatggcctacttatggaggagttttatataaacctcctcctcaaagaatgttttatattcctcaaagaccttatatgagtgttggaagtttaagagatcaagttatttatcctgatagtgttgaagatatgcaaagaaaaggatatagtgaacaagatttagaagctattttagatgttgttcatttacatcatattttacaaagagaaggaggatgggaagctatgtgcgattggaaagatgttttaagtggaggagaaaaacaaagaattggaatggctagaatgttttatcatagacctaaatatgctttattagatgaatgcactagtgctgttagtattgatgttgaaggaaaaatttttcaagctgctaaagatgctggaattgctttattaagtattactcatagacctagtttatggaaatatcatactcatttattacaatttgatggagaaggaggatggaaatttgaaaaattagatagtgctgctagattaagtttaactgaagaaaaacaaagattagaacaacaattagctggaattcctaaaatgcaaagaagattacaagaattatgccaaattttaggagaagctgttgctcctgctcatgttcctgctcctagtcctcaaggacctggaggattacaaggagctagtact

SEQ ID NO: 510 - DNA, 2235 bp, Artificial Sequence
  Exemplary ABCD1 coding sequence 10
atgccggtgctgagccgcccgcgcccgtggcgcggcaacaccctgaaacgcaccgcggtgctgctggcgctggcggcgtatggcgcgcataaagtgtatccgctggtgcgccagtgcctggcgccggcgcgcggcctgcaggcgccggcgggcgaaccgacccaggaagcgagcggcgtggcggcggcgaaagcgggcatgaaccgcgtgtttctgcagcgcctgctgtggctgctgcgcctgctgtttccgcgcgtgctgtgccgcgaaaccggcctgctggcgctgcatagcgcggcgctggtgagccgcacctttctgagcgtgtatgtggcgcgcctggatggccgcctggcgcgctgcattgtgcgcaaagatccgcgcgcgtttggctggcagctgctgcagtggctgctgattgcgctgccggcgacctttgtgaacagcgcgattcgctatctggaaggccagctggcgctgagctttcgcagccgcctggtggcgcatgcgtatcgcctgtattttagccagcagacctattatcgcgtgagcaacatggatggccgcctgcgcaacccggatcagagcctgaccgaagatgtggtggcgtttgcggcgagcgtggcgcatctgtatagcaacctgaccaaaccgctgctggatgtggcggtgaccagctataccctgctgcgcgcggcgcgcagccgcggcgcgggcaccgcgtggccgagcgcgattgcgggcctggtggtgtttctgaccgcgaacgtgctgcgcgcgtttagcccgaaatttggcgaactggtggcggaagaagcgcgccgcaaaggcgaactgcgctatatgcatagccgcgtggtggcgaacagcgaagaaattgcgttttatggcggccatgaagtggaactggcgctgctgcagcgcagctatcaggatctggcgagccagattaacctgattctgctggaacgcctgtggtatgtgatgctggaacagtttctgatgaaatatgtgtggagcgcgagcggcctgctgatggtggcggtgccgattattaccgcgaccggctatagcgaaagcgatgcggaagcggtgaaaaaagcggcgctggaaaaaaaagaagaagaactggtgagcgaacgcaccgaagcgtttaccattgcgcgcaacctgctgaccgcggcggcggatgcgattgaacgcattatgagcagctataaagaagtgaccgaactggcgggctataccgcgcgcgtgcatgaaatgtttcaggtgtttgaagatgtgcagcgctgccattttaaacgcccgcgcgaactggaagatgcgcaggcgggcagcggcaccattggccgcagcggcgtgcgcgtggaaggcccgctgaaaattcgcggccaggtggtggatgtggaacagggcattatttgcgaaaacattccgattgtgaccccgagcggcgaagtggtggtggcgagcctgaacattcgcgtggaagaaggcatgcatctgctgattaccggcccgaacggctgcggcaaaagcagcctgtttcgcattctgggcggcctgtggccgacctatggcggcgtgctgtataaaccgccgccgcagcgcatgttttatattccgcagcgcccgtatatgagcgtgggcagcctgcgcgatcaggtgatttatccggatagcgtggaagatatgcagcgcaaaggctatagcgaacaggatctggaagcgattctggatgtggtgcatctgcatcatattctgcagcgcgaaggcggctgggaagcgatgtgcgattggaaagatgtgctgagcggcggcgaaaaacagcgcattggcatggcgcgcatgttttatcatcgcccgaaatatgcgctgctggatgaatgcaccagcgcggtgagcattgatgtggaaggcaaaatttttcaggcggcgaaagatgcgggcattgcgctgctgagcattacccatcgcccgagcctgtggaaatatcatacccatctgctgcagtttgatggcgaaggcggctggaaatttgaaaaactggatagcgcggcgcgcctgagcctgaccgaagaaaaacagcgcctggaacagcagctggcgggcattccgaaaatgcagcgccgcctgcaggaactgtgccagattctgggcgaagcggtggcgccggcgcatgtgccggcgccgagcccgcagggcccgggcggcctgcagggcgcgagcacc

SEQ ID NO: 511-600 - skipped (90 entries)

SEQ ID NO: 601 - DNA, 145 bp, Artificial Sequence
  AAV2 5' ITR
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcct

SEQ ID NO: 602 - DNA, 145 bp, Artificial Sequence
  AAV2 3' ITR
aggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 603-610 - skipped (8 entries)

SEQ ID NO: 611 - DNA, 145 bp, Artificial Sequence; identical to SEQ ID NO: 601
  Original 5' ITR (AAV2) - Long (WPRE)

SEQ ID NO: 612 - DNA, 144 bp, Artificial Sequence
  Original 3' ITR (AAV2) - Long (WPRE)
aggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggcca

SEQ ID NO: 613-699 - skipped (87 entries)

SEQ ID NO: 700 - DNA, 6996 bp, Artificial Sequence
  pAAV2/9, full plasmid
cgcagggtctccattttgaagcgggaggtttgaacgcgcagccgccatgccggggttttacgagattgtgattaaggtccccagcgaccttgacgagcatctgcccggcatttctgacagctttgtgaactgggtggccgagaaggaatgggagttgccgccagattctgacatggatctgaatctgattgagcaggcacccctgaccgtggccgagaagctgcagcgcgactttctgacggaatggcgccgtgtgagtaaggccccggaggctcttttctttgtgcaatttgagaagggagagagctacttccacatgcacgtgctcgtggaaaccaccggggtgaaatccatggttttgggacgtttcctgagtcagattcgcgaaaaactgattcagagaatttaccgcgggatcgagccgactttgccaaactggttcgcggtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagcgtaaacggttggtggcgcagcatctgacgcacgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttcaatgcggcctccaactcgcggtcccaaatcaaggctgccttggacaatgcgggaaagattatgagcctgactaaaaccgcccccgactacctggtgggccagcagcccgtggaggacatttccagcaatcggatttataaaattttggaactaaacgggtacgatccccaatatgcggcttccgtctttctgggatgggccacgaaaaagttcggcaagaggaacaccatctggctgtttgggcctgcaactaccgggaagaccaacatcgcggaggccatagcccacactgtgcccttctacgggtgcgtaaactggaccaatgagaactttcccttcaacgactgtgtcgacaagatggtgatctggtgggaggaggggaagatgaccgccaaggtcgtggagtcggccaaagccattctcggaggaagcaaggtgcgcgtggaccagaaatgcaagtcctcggcccagatagacccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtcagttgcgcagccatcgacgtcagacgcggaagcttcgatcaactacgcagacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactgtgctacattcatcatatcatgggaaaggtgccagacgcttgcactgcctgcgatctggtcaatgtggatttggatgactgcatctttgaacaataaatgacttaaaccaggtatggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaattgcttgttaatcaataaaccgtttaattcgtttcagttgaactttggtctctgcgaagggcgaattcgtttaaacctgcaggactagaggtcctgtattagaggtcacgtgagtgttttgcgacattttgcgacaccatgtggtcacgctgggtatttaagcccgagtgagcacgcagggtctccattttgaagcgggaggtttgaacgcgcagccgccaagccgaattcatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggat

SEQ ID NO: 701-709 - skipped (9 entries)

SEQ ID NO: 710 - DNA, 99 bp, Artificial Sequence
  AAV2 p5
gaggtcctgtattagaggtcacgtgagtgttttgcgacattttgcgacaccatgtggtcacgctgggtatttaagcccgagtgagcacgcagggtctcc

SEQ ID NO: 711 - protein, 621 aa, Artificial Sequence
  AAV2 REP78
MPGFYEIVIKVPSDLDEHLPGISDSFVNWVAEKEWELPPDSDMDLNLIEQAPLTVAEKLQRDFLTEWRRVSKAPEALFFVQFEKGESYFHMHVLVETTGVKSMVLGRFLSQIREKLIQRIYRGIEPTLPNWFAVTKTRNGAGGGNKVVDECYIPNYLLPKTQPELQWAWTNMEQYLSACLNLTERKRLVAQHLTHVSQTQEQNKENQNPNSDAPVIRSKTSARYMELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRYQNKCSRHVGMNLMLFPCRQCERMNQNSNICFTHGQKDCLECFPVSESQPVSVVKKAYQKLCYIHHIMGKVPDACTACDLVNVDLDDCIFEQ

SEQ ID NO: 712 - protein, 535 aa, Artificial Sequence
  AAV2 REP68
MPGFYEIVIKVPSDLDEHLPGISDSFVNWVAEKEWELPPDSDMDLNLIEQAPLTVAEKLQRDFLTEWRRVSKAPEALFFVQFEKGESYFHMHVLVETTGVKSMVLGRFLSQIREKLIQRIYRGIEPTLPNWFAVTKTRNGAGGGNKVVDECYIPNYLLPKTQPELQWAWTNMEQYLSACLNLTERKRLVAQHLTHVSQTQEQNKENQNPNSDAPVIRSKTSARYMELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRLARGQP

SEQ ID NO: 713-719 - skipped (7 entries)

SEQ ID NO: 720 - DNA, 154 bp, Artificial Sequence
  AAV2 p19
gtcacaaagaccagaaatggcgccggaggcgggaacaaggtggtggatgagtgctacatccccaattacttgctccccaaaacccagcctgagctccagtgggcgtggactaatatggaacagtatttaagcgcctgtttgaatctcacggagc

SEQ ID NO: 721 - protein, 397 aa, Artificial Sequence
  AAV2 REP52
MELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRYQNKCSRHVGMNLMLFPCRQCERMNQNSNICFTHGQKDCLECFPVSESQPVSVVKKAYQKLCYIHHIMGKVPDACTACDLVNVDLDDCIFEQ

SEQ ID NO: 722 - protein, 311 aa, Artificial Sequence
  AAV2 REP40
MELVGWLVDKGITSEKQWIQEDQASYISFNAASNSRSQIKAALDNAGKIMSLTKTAPDYLVGQQPVEDISSNRIYKILELNGYDPQYAASVFLGWATKKFGKRNTIWLFGPATTGKTNIAEAIAHTVPFYGCVNWTNENFPFNDCVDKMVIWWEEGKMTAKVVESAKAILGGSKVRVDQKCKSSAQIDPTPVIVTSNTNMCAVIDGNSTTFEHQQPLQDRMFKFELTRRLDHDFGKVTKQEVKDFFRWAKDHVVEVEHEFYVKKGGAKKRPAPSDADISEPKRVRESVAQPSTSDAEASINYADRLARGQP

SEQ ID NO: 723-729 - skipped (7 entries)

SEQ ID NO: 730 - DNA, 154 bp, Artificial Sequence
  AAV p40
ggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggtgcgcgagtca

SEQ ID NO: 731 - protein, 736 aa, Artificial Sequence
  AAV9 VP1
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 732 - protein, 599 aa, Artificial Sequence
  AAV9 VP2
TAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 733 - protein, 534 aa, Artificial Sequence
  AAV9 VP3
MASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 734-830 - skipped (97 entries)

SEQ ID NO: 831 - protein, 735 aa, Artificial Sequence [sequence omitted]

SEQ ID NO: 832 - protein, 598 aa, Artificial Sequence
  AAV2 VP2
MAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 833 - protein, 533 aa, Artificial Sequence
  AAV2 VP3
MATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 834-930 - skipped (97 entries)

SEQ ID NO: 931 - protein, 738 aa, Artificial Sequence
  AAVrh10 VP1
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 932 - protein, 601 aa, Artificial Sequence
  AAVrh10 VP2
TAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 933 - protein, 535 aa, Artificial Sequence
  AAVrh10 VP3
MAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 934-1999 - skipped (1066 entries)

SEQ ID NO: 2000 - DNA, 32767 bp, Artificial Sequence
  Adenovirus 5 (WT)
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgtccttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccttggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacacttttt

SEQ ID NO: 2001-2009 - skipped (9 entries)

SEQ ID NO: 2010 - DNA, 3415 bp, Artificial Sequence
  pALD-X80, Ad5 Region VA-RNA
tcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagcgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggcacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagttt

SEQ ID NO: 2011 - DNA, 157 bp, Artificial Sequence
  Ad5 VA-RNA region (VA RNA I)
gggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctcct

SEQ ID NO: 2012 - DNA, 158 bp, Artificial Sequence
  Ad5 VA-RNA region (VA RNA II)
ggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagcccct

SEQ ID NO: 2013-2019 - skipped (7 entries)

SEQ ID NO: 2020 - DNA, 6688 bp, Artificial Sequence
  pALD-X80, Ad5 Region E2
gcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgcctaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgttgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatacgcgcccaccgaaaccgaattctcctggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgctcttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccctggattacatcaagatc

SEQ ID NO: 2021 - protein, 84 aa, Artificial Sequence
  Ad5 Region E2, Hexon (C-terminal fragement)
TLWRIPFSSNFMSMGALTDLGQNLLYANSAHALDMTFEVDPMDEPTLLYVLFEVFDVVRVHQPHRGVIETVYLRTPFSAGNATT

SEQ ID NO: 2022 - protein, 204 aa, Artificial Sequence
  Ad5 Region E2, 23K endoprotease
MGSSEQELKAIVKDLGCGPYFLGTYDKRFPGFVSPHKLACAIVNTAGRETGGVHWMAFAWNPHSKTCYLFEPFGFSDQRLKQVYQFEYESLLRRSAIASSPDRCITLEKSTQSVQGPNSAACGLFCCMFLHAFANWPQTPMDHNPTMNLITGVPNSMLNSPQVQPTLRRNQEQLYSFLERHSPYFRSHSAQIRSATSFCHLKNM

SEQ ID NO: 2023 - protein, 529 aa, Artificial Sequence
  Ad5 Region E2, E2A/DBP
MASREEEQRETTPERGRGAARRPPTMEDVSSPSPSPPPPRAPPKKRMRRRIESEDEEDSSQDALVPRTPSPRPSTSAADLAIAPKKKKKRPSPKPERPPSPEVIVDSEEEREDVALQMVGFSNPPVLIKHGKGGKRTVRRLNEDDPVARGMRTQEEEEEPSEAESEITVMNPLSVPIVSAWEKGMEAARALMDKYHVDNDLKANFKLLPDQVEALAAVCKTWLNEEHRGLQLTFTSNKTFVTMMGRFLQAYLQSFAEVTYKHHEPTGCALWLHRCAEIEGELKCLHGSIMINKEHVIEMDVTSENGQRALKEQSSKAKIVKNRWGRNVVQISNTDARCCVHDAACPANQFSGKSCGMFFSEGAKAQVAFKQIKAFMQALYPNAQTGHGHLLMPLRCECNSKPGHAPFLGRQLPKLTPFALSNAEDLDADLISDKSVLASVHHPALIVFQCCNPVYRNSRAQGGGPNCDFKISAPDLLNALVMVRSLWSENFTELPRMVVPEFKWSTKHQYRNVSLPVAHSDARQNPFDF

SEQ ID NO: 2024 - protein, 807 aa, Artificial Sequence
  Ad5 Region E2, Hexon Assembly (100K)
MESVEKKDSLTAPSEFATTASTDAANAPTTFPVEAPPLEEEEVIIEQDPGFVSEDDEDRSVPTEDKKQDQDNAEANEEQVGRGDERHGDYLDVGDDVLLKHLQRQCAIICDALQERSDVPLAIADVSLAYERHLFSPRVPPKRQENGTCEPNPRLNFYPVFAVPEVLATYHIFFQNCKIPLSCRANRSRADKQLALRQGAVIPDIASLNEVPKIFEGLGRDEKRAANALQQENSENESHSGVLVELEGDNARLAVLKRSIEVTHFAYPALNLPPKVMSTVMSELIVRRAQPLERDANLQEQTEEGLPAVGDEQLARWLQTREPADLEERRKLMMAAVLVTVELECMQRFFADPEMQRKLEETLHYTFRQGYVRQACKISNVELCNLVSYLGILHENRLGQNVLHSTLKGEARRDYVRDCVYLFLCYTWQTAMGVWQQCLEECNLKELQKLLKQNLKDLWTAFNERSVAAHLADIIFPERLLKTLQQGLPDFTSQSMLQNFRNFILERSGILPATCCALPSDFVPIKYRECPPPLWGHCYLLQLANYLAYHSDIMEDVSGDGLLECHCRCNLCTPHRSLVCNSQLLNESQIIGTFELQGPSPDEKSAAPGLKLTPGLWTSAYLRKFVPEDYHAHEIRFYEDQSRPPNAELTACVITQGHILGQLQAINKARQEFLLRKGRGVYLDPQSGEELNPIPPPPQPYQQQPRALASQDGTQKEAAAAAATHGRGGILGQSGRGGFGRGGGGHDGRLGEPRRGSFRGRRGVRRNTVTLGRIPLAGAPEIGNRFQHGYNLRSSGAAGTARSPTQP

SEQ ID NO: 2025 - protein, 227 aa, Artificial Sequence
  Ad5 Region E2, Hexon Assembly (33K)
MAPKKKLQLPPPPTDEEEYWDSQAEEVLDEEEEDMMEDWESLDEEASEVEEVSDETPSPSVAFPSPAPQKSATGSSMATTSAPQAPPALPVRRPNRRWDTTGTRAAHTAPAAAAATAAATQKQRRPDSKTLTKPKKSTAAAAAGGGALRLAPNEPVSTRELRNRIFPTLYAIFQQSRGQEQELKIKNRSLRSLTRSCLYHKSEDQLRRTLEDAEALFSKYCALTLKD

SEQ ID NO: 2026 - protein, 194 aa, Artificial Sequence
  Ad5 Region E2, Hexon Assembly (22K)
MAPKKKLQLPPPPTDEEEYWDSQAEEVLDEEEEDMMEDWESLDEEASEVEEVSDETPSPSVAFPSPAPQKSATGSSMATTSAPQAPPALPVRRPNRRWDTTGTRAGKSKQPPPLAQEQQQRQGYRSWRGHKNAIVACLQDCGGNISFARRFLLYHHGVAFPRNILHYYRHLYSPYCTGGSGSNSSGHTEAKATG

SEQ ID NO: 2027 - protein, 227 aa, Artificial Sequence
  Ad5 Region E2, Hexon-associated precursor
MSKEIPTPYMWSYQPQMGLAAGAAQDYSTRINYMSAGPHMISRVNGIRAHRNRILLEQAAITTTPRNNLNPRSWPAALVYQESPAPTTVVLPRDAQAEVQMTNSGAQLAGGFRHRVRSPGQGITHLTIRGRGIQLNDESVSSSLGLRPDGTFQIGGAGRSSFTPRQAILTLQTSSSEPRSGGIGTLQFIEEFVPSVYFNPFSGPPGHYPDQFIPNFDAVKDSADGYD

SEQ ID NO: 2028-2029 - skipped (2 entries)

SEQ ID NO: 2030 - DNA, 5102 bp, Artificial Sequence
  pALD-X80, Ad5 Region E4
gatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtcacttcccattttaagaaaactacaattcccaacacatacaagttactccgccctaaaacctacgtcacccgccccgttcccacgccccgcgccacgtcacaaactccaccccctcattatcatattggcttcaatccaaaataa

SEQ ID NO: 2031 - protein, 581 aa, Artificial Sequence
  Ad5 Region E4, Fiber
MKRARPSEDTFNPVYPYDTETGPPTVPFLTPPFVSPNGFQESPPGVLSLRLSEPLVTSNGMLALKMGNGLSLDEAGNLTSQNVTTVSPPLKKTKSNINLEISAPLTVTSEALTVAAAAPLMVAGNTLTMQSQAPLTVHDSKLSIATQGPLTVSEGKLALQTSGPLTTTDSSTLTITASPPLTTATGSLGIDLKEPIYTQNGKLGLKYGAPLHVTDDLNTLTVATGPGVTINNTSLQTKVTGALGFDSQGNMQLNVAGGLRIDSQNRRLILDVSYPFDAQNQLNLRLGQGPLFINSAHNLDINYNKGLYLFTASNNSKKLEVNLSTAKGLMFDATAIAINAGDGLEFGSPNAPNTNPLKTKIGHGLEFDSNKAMVPKLGTGLSFDSTGAITVGNKNNDKLTLWTTPAPSPNCRLNAEKDAKLTLVLTKCGSQILATVSVLAVKGSLAPISGTVQSAHLIIRFDENGVLLNNSFLDPEYWNFRNGDLTEGTAYTNAVGFMPNLSAYPKSHGKTAKSNIVSQVYLNGDKTKPVTLTITLNGTQETGDTTPSAYSMSFSWDWSGHNYINEIFATSSYTFSYIAQE

SEQ ID NO: 2032 - protein, 128 aa, Artificial Sequence
  Ad5 Region E4, ORF1
MAAAVEALYVVLEREGAILPRQEGFSGVYVFFSPINFVIPPMGAVMLSLRLRVCIPPGYFGRFLALTDVNQPDVFTESYIMTPDMTEELSVVLFNHGDQFFYGHAGMAVVRLMLIRVVFPVVRQASNV

SEQ ID NO: 2033 - protein, 130 aa, Artificial Sequence
  Ad5 Region E4, ORF2
MFERKMVSFSVVVPELTCLYLHEHDYDVLSFLREALPDFLSSTLHFISPPMQQAYIGATLVSIAPSMRVIISVGSFVMVPGGEVAALVRADLHDYVQLALRRDLRDRGIFVNVPLLNLIQVCEEPEFLQS

SEQ ID NO: 2034 - protein, 116 aa, Artificial Sequence
  Ad5 Region E4, ORF3
MIRCLRLKVEGALEQIFTMAGLNIRDLLRDILRRWRDENYLGMVEGAGMFIEEIHPEGFSLYVHLDVRAVCLLEAIVQHLTNAIICSLAVEFDHATGGERVHLIDLHFEVLDNLLE

SEQ ID NO: 2035 - protein, 114 aa, Artificial Sequence
  Ad5 Region E4, ORF4
MVLPALPAPPVCDSQNECVGWLGVAYSAVVDVIRAAAHEGVYIEPEARGRLDALREWIYYNYYTERSKRRDRRRRSVCHARTWFCFRKYDYVRRSIWHDTTTNTISVVSAHSVQ

SEQ ID NO: 2036 - protein, 294 aa, Artificial Sequence
  Ad5 Region E4, ORF6
MTTSGVPFGMTLRPTRSRLSRRTPYSRDRLPPFETETRATILEDHPLLPECNTLTMHNVSYVRGLPCSVGFTLIQEWVVPWDMVLTREELVILRKCMHVCLCCANIDIMTSMMIHGYESWALHCHCSSPGSLQCIAGGQVLASWFRMVVDGAMFNQRFIWYREVVNYNMPKEVMFMSSVFMRGRHLIYLRLWYDGHVGSVVPAMSFGYSALHCGILNNIVVLCCSYCADLSEIRVRCCARRTRRLMLRAVRIIAEETTAMLYSCRTERRRQQFIRALLQHHRPILMHDYDSTPM

SEQ ID NO: 2037 - protein, 150 aa, Artificial Sequence
  Ad5 Region E4, ORF6/7
MTTSGVPFGMTLRPTRSRLSRRTPYSRDRLPPFETETRATILEDHPLLPECNTLTMHNAWTSPSPPVKQPQVGQQPVAQQLDSDMNLSELPGEFINITDERLARQETVWNITPKNMSVTHDMMLFKASRGERTVYSVCWEGGGRLNTRVL

SEQ ID NO: 2038-2999 - skipped (962 entries)

SEQ ID NO: 3000 - DNA, 32767 bp, Artificial Sequence
  Adenovirus 2 (WT)
catcatcataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgccggatgtggtaaaagtgacgtttttggtgtgcgccggtgtatacgggaagtgacaattttcgcgcggttttaggcggatgttgtagtaaatttgggcgtaaccaagtaatgtttggccattttcgcgggaaaactgaataagaggaagtgaaatctgaataattctgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgcgcagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgagtctgtaatgttggcggtgcaggaagggattgacttattcacttttccgccggcgcccggttctccggagccgcctcacctttcccggcagcccgagcagccggagcagagagccttgggtccggtttctatgccaaaccttgtgccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtcggtgatagagtggtgggtttggtgtggtaatttttttttaatttttacagttttgtggtttaaagaattttgtattgtgattttttaaaaggtcctgtgtctgaacctgagcctgagcccgagccagaaccggagcctgcaagacctacccggcgtcctaaattggtgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagtctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcctcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggtggtgagacacaagaatcgcctgctactgttgtcttccgtccgcccggcaataataccgacggaggagcaacagcaggaggaagccaggcggcggcggcggcaggagcagagcccatggaacccgagagccggcctggaccctcgggaatgaatgttgtacaggtggctgaactgtttccagaactgagacgcattttaaccattaacgaggatgggcaggggctaaagggggtaaagagggagcggggggcttctgaggctacagaggaggctaggaatctaacttttagcttaatgaccagacaccgtcctgagtgtgttacttttcagcagattaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagattagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtgaggtttactggtcccaattttagcggtacggttttcctggccaataccaatcttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctgtttgaaaggtgtaccttgggtatcctgtctgagggtaactccagggtgcgccacaatgtggcctccgactgtggttgcttcatgctagtgaaaagcgtggctgtgattaagcataacatggtgtgtggcaactgcgaggacagggcctctcagatgctgacctgctcggacggcaactgtcacttgctgaagaccattcacgtagccagccactctcgcaaggcctggccagtgtttgagcacaacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtctcatgtagttttgtatctgttttgcagcagccgccgccatgagcgccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaccagactctgtttggattttgatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccgagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaaccgtttccggggtaggggagatcagctgggaagaaagcaggttcctgagcagctgcgacttaccgcagccggtgggcccgtaaatcacacctattaccggctgcaactggtagttaagagagctgcagctgccgtcatccctgagcaggggggccacttcgttaagcatgtccctgacttgcatgttttccctgaccaaatgcgccagaaggcgctcgccgcccagcgatagcagttcttgcaaggaagcaaagtttttcaacggtttgaggccgtccgccgtaggcatgcttttgagcgtttgaccaagcagttccaggcggtcccacagctcggtcacgtgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttaagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacgaaggctcgcgtccaggccagcacgaaggaggctaagtgggaggggtagcggtcgttgtccactagggggtccactcgctccagggtgtgaagacacatgtcgccctcttcggcatcaaggaaggtgattggtttataggtgtaggccacgtgaccgggtgttcctgaaggggggctataaaagggggtgggggcgcgttcgtcctcactctcttccgcatcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgaacagaatggcggtagtgggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctaaccatgactttgaggtactggtatttgaagtcagtgtcgtcgcatccgccctgctcccagagcaaaaagtccgtgcgctttttggaacgcgggtttggcagggcgaaggtgacatcgttgaaaagtatctttcccgcgcgaggcataaagttgcgtgtgatgcggaagggtcccggcacctcggaacggttgttaattacctgggcggcgagcacgatctcgtcgaagccgttgatgttgtggcccacgatgtaaagttccaagaagcgcggggtgcccttgatggagggcaattttttaagttcctcgtaggtgagctcctcaggggagctgagcccgtgttctgacagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggtccacggctaggtctcgcgcggcggtcaccagaggctcatctccgccgaacttcataaccagcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttatggtggatcggaccaccacgccgcgcgagcccaaagtccagatgtccgcgcgcggcggtcggagcttgatgacaacatcgcgcagatgggagctgtccatggtctggagctcccgcggcgacaggtcaggcgggagctcctgcaggtttacctcgcatagccgggtcagggcgcgggctaggtccaggtgatacctgatttccaggggctggttggtggcggcgtcgatgacttgcaagaggccgcatccccgcggcgcgactacggtaccgcgcggcgggcggtgggccgcgggggtgtccttggatgatgcatctaaaagcggtgacgcgggcgggcccccggaggtagggggggctcgggacccgccgggagagggggcaggggcacgtcggcgccgcgcgcgggcaggagctggtgctgcgcgcggaggttgctggcgaacgcgacgacgcggcggttgatctcctgaatctggcgcctctgcgtgaagacgacgggcccggtgagcttgaacctgaaagagagttcgacagaatcaatttcggtgtcgttgacggcggcctggcgcaaaatctcctgcacgtctcctgagttgtcttgataggcgatttcggccatgaactgctcgatctcttcctcctggagatctccgcgtccggctcgctccacggtggcggcgaggtcgttggagatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcaatctcctcttccataagggcctccccttcttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccgtgcggcagggatacggcgctaacgatgcatctcaacaattgttgtgtaggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctacggcggcggcggagtttggccgtaggtggcgccctcttcctcccatgcgtgtgaccccgaagcccctcatcggctgaagcagggccaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagcccttgagtcaaagacgtagtcgttgcaagtccgcaccaggtactgatatcccaccaaaaagtgcggcggcggctggcggtagaggggccagcgtagggtggccggggctccgggggcgaggtcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtgaggcgtgcgcagtcgttgacgctctagaccgtgcaaaaggagagcctgtaagcgggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctccttttggcttccttccaggcgcggcggctgctgcgctagcttttttggccactggccgcgcgcggcgtaagcggttaggctggaaagcgaaagcattaagtggctcgctccctgtagccggagggttattttccaagggttgagtcgcaggacccccggttcgagtctcgggccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctccccttctcctaccgcgtcaggaggggcaacatccgcggctgacgcggcggcagatggtgattacgaacccccgcggcgccgggcccggcactacctggacttggaggagggcgagggcctggcgcggctaggagcgccctctcctgagcgacacccaagggtgcagctgaagcgtgacacgcgcgaggcgtacgtgccgcggcagaacctgtttcgcgaccgcgagggagaggagcccgaggagatgcgggatcgaaagttccacgcagggcgcgagttgcggcatggcctgaaccgcgagcggttgctgcgcgaggaggactttgagcccgacgcgcggaccgggattagtcccgcgcgcgcacacgtggcggccgccgacctggtaaccgcgtacgagcagacggtgaaccaggagattaactttcaaaaaagctttaacaaccacgtgcgcacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacattctgcagagcatagtggtgcaggagcgcagcttgagcctggctgacaaggtggccgccattaactattccatgctcagtctgggcaagttttacgcccgcaagatataccataccccttacgttcccatagacaaggaggtaaagatcgaggggttctacatgcgcatggcgttgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgtaaccctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgatgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtccgggccagactattttttccagaccagtagacaaggcctgcagaccgtaaacctgagccaggctttcaagaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctgaactacctgctgaccaaccggcggcagaagatcccctcgttgcacagtttaaacagcgaggaggagcgcatcttgcgctatgtgcagcagagcgtgagccttaacctgatgcgcgacggggtaacgcccagcgtggcgctggacatgaccgcgcgcaacatggaaccgggcatgtatgcctcaaaccggccgtttatcaatcgcctaatggactacttgcatcgcgcggccgccgtgaaccccgagtatttcaccaatgccatcttgaacccgcactggctaccgccccctggtttctacaccgggggatttgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgcgagtagcccatttccaagcttgatagggtcttttaccagcactcgcaccacccgcccgcgcctgctgggcgaggaggagtacctaaacaactcgctgctgcagccgcagcgcgaaaagaacctgcctccggcatttcccaacaacgggatagagagcctagtggacaagatgagtagatggaagacgtatgcgcaggagcacagggatgtgcccggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaaaaaaagcatgatgcaaaataaaaaactcaccaaggccatggcaccgagcgttggttttcttgtattccccttagtatgcagcgcgcggcgatgtatgaggaaggtcctcctccctcctacgagagcgtggtgagcgcggcgccagtggcggcggcgctgggttcccccttcgatgctcccctggacccgccgtttgtgcctccgcggtacctgcggcctaccggggggagaaacagcatccgttactctgagttggcacccctattcgacaccacccgtgtgtaccttgtggacaacaagtcaacggatgtggcatccctgaactaccagaacgaccacagcaactttctaaccacggtcattcaaaacaatgactacagcccgggggaggcaagcacacagaccatcaatcttgacgaccgttcgcactggggcggcgacctgaaaaccatcctgcataccaacatgccaaatgtgaacgagttcatgtttaccaataagtttaaggcgcgggtgatggtgtcgcgctcgcttactaaggacaaacaggtggagctgaaatatgagtgggtggagttcacgctgcccgagggcaactactccgagaccatgaccatagaccttatgaacaacgcgatcgtggagcactacttgaaagtgggcaggcagaacggggttctggaaagcgacatcggggtaaagtttgacacccgcaacttcagactggggtttgacccagtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgacctggagggtggtaacattcccgcactgttggatgtggacgcctaccaggcaagcttaaaagatgacaccgaacagggcggggatggcgcaggcggcggcaacaacagtggcagcggcgcggaagagaactccaacgcggcagccgcggcaatgcagccggtggaggacatgaacgatcatgccattcgcggcgacacctttgccacacgggcggaggagaagcgcgctgaggccgaggcagcggcagaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccgggatccgctcatggaccctcctttgcactcctgacgtaacctgcggctcggagcaggtctactggtcgttgccagacatgatgcaagaccccgtgaccttccgctccacgagccagatcagcaactttccggtggtgggcgccgagctgttgcccgtgcactccaagagcttctacaacgaccaggccgtctactcccagctcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaaacatgtccatccttatatcgcccagcaataacacaggctggggcctgcgcttcccaagcaagatgtttggcggggcaaagaagcgctccgaccaacacccagtgcgcgtgcgcgggcactaccgcgcgccctggggcgcgcacaaacgcggccgcactgggcgcaccaccgtcgatgacgccattgacgcggtggtggaggaggcgcgcaactacacgcccacgccgccaccagtgtccacagtggacgcggccattcagaccgtggtgcgcggagcccggcgttatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtactgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgatgaacttgacgacgaggtggaactgctgcacgcaaccgcgcccaggcggcgggtacagtggaaaggtcgacgcgtaagacgtgttttgcgacccggcaccaccgtagtttttacgcccggtgagcgctccacccgcacctacaagcgcgtgtatgatgaggtgtacggcgacgaggacctgcttgagcaggccaacgagcgcctcggggagtttgcctacggaaagcggcataaggacatgttggcgttgccgctggacgagggcaacccaacacctagcctaaagcccgtgacactgcagcaggtgctgcccacgcttgcaccgtccgaagaaaagcgcggcctaaagcgcgagtctggtgacttggcacccaccgtgcagctgatggtacccaagcgccagcgactggaagatgtcttggaaaaaatgaccgtggagcctgggctggagcccgaggtccgcgtgcggccaatcaagcaggtggcaccgggactgggcgtgcagaccgtggacgttcagatacccaccaccagtagcactagtattgccactgccacagagggcatggagacacaaacgtccccggttgcctcggcggtggcagatgccgcggtgcaggcggccgctgcggccgcgtccaaaacctctacggaggtgcaaacggacccgtggatgtttcgcgtttcagccccccggcgcccgcgccgttccaggaagtacggcaccgccagcgcactactgcccgaatatgccctacatccttccatcgcgcctacccccggctatcgtggctacacctaccgccccagaagacgagcgactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggagtctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccattaagaactatggcagcaaggcctggaacagcagcacaggccagatgctgagggacaagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcggcccgacagggaagaaactctggtgacgcaaatagatgagcctccctcgtacgaggaggcactaaagcaaggcctgcccaccacccgtcccatcgcgcccatggctaccggagtgctgggccagcacacacctgtaacgctggacctgcctccccccgctgacacccagcagaaacctgtgctgccagggccgtccgccgttgttgtaacccgccctagccgcgcgtccctgcgccgtgccgccagcggtccgcgatcgatgcggcccgtagccagtggcaactggcaaagcacactgaacagcatcgtgggtctgggggtgcaatccctgaagcgccgacgatgcttctaaatagctaacgtgtcgtatgtgtcatgtatgcgtccatgtcgccgccagaggagctgctgagccgccgtgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcacctacgcacgacgtaaccacagaccggtcccagcgtttgacgctgcggttcatccctgtggaccgcgaggataccgcgtactcgtacaaagcgcggttcaccctggctgtgggtgacaaccgtgtgcttgatatggcttccacgtactttgacatccgcggcgtgctggacagggggcctacttttaagccctactccggcactgcctacaacgctctagctcccaagggcgctcctaactcctgtgagtgggaacaaaccgaagatagcggccgggcagttgccgaggatgaagaagaggaagatgaagatgaagaagaggaagaagaagagcaaaacgctcgagatcaggctactaagaaaacacatgtctatgcccaggctcctttgtctggagaaacaattacaaaaagcgggctacaaataggatcagacaatgcagaaacacaagctaaacctgtatacgcagatccttcctatcaaccagaacctcaaattggcgaatctcagtggaacgaagctgatgctaatgcggcaggagggagagtgcttaaaaaaacaactcccatgaaaccatgctatggatcttatgccaggcctacaaatccttttggtggtcaatccgttctggttccggatgaaaaaggggtgcctcttccaaaggttgacttgcaattcttctcaaatactacctctttgaacgaccggcaaggcaatgctactaaaccaaaagtggttttgtacagtgaagatgtaaatatggaaaccccagacacacatctgtcttacaaacctggaaaaggtgatgaaaattctaaagctatgttgggtcaacaatctatgccaaacagacccaattacattgctttcagggacaattttattggcctaatgtattataacagcactggcaacatgggtgttcttgctggtcaggcatcgcagctaaatgccgtggtagatttgcaagacagaaacacagagctgtcctatcaactcttgcttgattccataggtgatagaaccagatatttttctatgtggaatcaggctgtagacagctatgatccagatgttagaatcattgaaaaccatggaactgaggatgaattgccaaattattgttttcctcttgggggtattggggtaactgacacctatcaagctattaaggctaatggcaatggctcaggcgataatggagatactacatggacaaaagatgaaacttttgcaacacgtaatgaaataggagtgggtaacaactttgccatggaaattaacctaaatgccaacctatggagaaatttcctttactccaatattgcgctgtacctgccagacaagctaaaatacaaccccaccaatgtggaaatatctgacaaccccaacacctacgactacatgaacaagcgagtggtggctcccgggcttgtagactgctacattaaccttggggcgcgctggtctctggactacatggacaacgttaatccctttaaccaccaccgcaatgcgggcctccgttatcgctccatgttgttgggaaacggccgctacgtgccctttcacattcaggtgccccaaaagttttttgccattaaaaacctcctcctcctgccaggctcatatacatatgaatggaacttcaggaaggatgttaacatggttctgcagagctctctgggaaacgatcttagagttgacggggctagcattaagtttgacagcatttgtctttacgccaccttcttccccatggcccacaacacggcctccacgctggaagccatgctcagaaatgacaccaacgaccagtcctttaatgactacctttccgccgccaacatgctataccccatacccgccaacgccaccaacgtgcccatctccatcccatcgcgcaactgggcagcatttcgcggttgggccttcacacgcttgaagacaaaggaaaccccttccctgggatcaggctacgacccttactacacctactctggctccataccataccttgacggaaccttctatcttaatcacacctttaagaaggtggccattacctttgactcttctgttagctggccgggcaacgaccgcctgcttactcccaatgagtttgagattaaacgctcagttgacggggagggctacaacgtagctcagtgcaacatgaccaaggactggttcctggtgcagatgttggccaactacaatattggctaccagggcttctacattccagaaagctacaaggaccgcatgtactcgttcttcagaaacttccagcccatgagccggcaagtggttgacgatactaaatacaaggagtatcagcaggttggaattcttcaccagcataacaactcaggattcgtaggctacctcgctcccaccatgcgcgagggacaggcttaccccgccaacgtgccctacccactaataggcaaaaccgcggttgacagtattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccagccgcaccgcggcgtcatcgagaccgtgtacctgcgcacgcccttctcggccggcaacgccacaacataaaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcgctcaaaaacatgctacctctttgagccctttggcttttctgaccaacgactcaagcaggtttaccagtttgagtacgagtcactcctgcgccgtagcgccattgcttcttcccccgaccgctgtataacgctggaaaagtccacccaaagcgtgcaggggcccaactcggccgcctgtggactattctgctgcatgtttctccacgcctttgccaactggccccaaactcccatggatcacaaccccaccatgaaccttattaccggggtacccaactccatgcttaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactaggagacactttcaataaaggcaaatgtttttatttgtacactctcgggtgattatttaccccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccggtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcgtccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgacacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaggatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaaacgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgcctcgggcaaaacgtgcttcattccacgctcaagggcgaggcgcgccgcgactacgtccgcgactgcgtttacttatttctgtgctacacctggcaaacggccatgggcgtgtggcagcaatgcctggaggagcgcaacctaaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttctgcagctagccaactaccttgcctaccactccgacatcatggaagacgtgagcggtgacggcctactggagtgtcactgtcgctgcaacctatgcaccccgcaccgctccctggtctgcaattcgcaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccatcaacaaagcccgccaagagtttctgctacgaaagggacggggggtttacctggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaagcttccgaggccgaagaggtgtcagacgaaacaccgtcaccctcggtcgcattcccctcgccggcgccccagaaattggcaaccgttcccagcatcgctacaacctccgctcctcaggcgccgccggcactgcctgttcgccgacccaaccgtagatgggacaccactggaaccagggccggtaagtctaagcagccgccgccgttagcccaagagcaacaacagcgccaaggctaccgctcgtggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcggcagcaacagcagcggtcacacagaagcaaaggcgaccggatagcaagactctgacaaagcccaagaaatccacagcggcggcagcagcaggaggaggagcgctgcgtctggcgcccaacgaacccgtatcgacccgcgagcttagaaataggatttttcccactctgtatgctatatttcaacaaagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgaaaatcagagggcgaggtattcagctcaacgacgagtcggtgagctcctctcttggtctccgtccggacgggacatttcagatcggcggcgctggccgctcttcatttacgccccgtcaggcgatcctaactctgcagacctcgtcctcggagccgcgctccggaggcattggaactctacaatttattgaggagttcgtgccttcggtttacttcaaccccttttctggacctcccggccactacccggaccagtttattcccaactttgacgcggtgaaagactcggcggacggctacgactgaatgaccagtggagaggcagagcgactgcgcctgacacacctcgaccactgccgccgccacaagtgctttgcccgcggctccggtgagttttgttactttgaattgcccgaagagcatatcgagggcccggcgcacggcgtccggctcaccacccaggtagagcttacacgtagcctgattcgggagtttaccaagcgccccctgctagtggagcgggagcggggtccctgtgttctgaccgtggtttgcaactgtcctaaccctggattacatcaagatctttgttgtcatctctgtgctgagtataataaatacagaaattagaatctactggggctcctgtcgccatcctgtgaacgccaccgtttttacccacccaaagcagaccaaagcaaacctcacctccggtttgcacaagcgggccaataagtaccttacctggtactttaacggctcttcatttgtaatttacaacagtttccagcgagacgaagtaagtttgccacacaaccttctcggcttcaactacaccgtcaagaaaaacaccaccaccaccaccctcctcacctgccgggaacgtacgagtgcgtcaccggttgctgcgcccacacctacagcctgagcgtaaccagacattactcccatttttccaaaacaggaggtgagctcaactcccggaactcaggtcaaaaaagcattttgcggggtgctgggattttttaattaagtatatgagcaattcaagtaactctacaagcttgtctaatttttctggaattggggtcggggttatccttactcttgtaattctgtttattcttatactagcacttctgtgccttagggttgccgcctgctgcacgcacgtttgtacctattgtcagctttttaaacgctgggggcaacatccaagatgaggtacatgattttaggcttgctcgcccttgcggcagtctgcagcgctgccaaaaaggttgagtttaaggaaccagcttgcaatgttacatttaaatcagaagctaatgaatgcactactcttataaaatgcaccacagaacatgaaaagcttattattcgccacaaagacaaaattggcaagtatgctgtatatgctatttggcagccaggtgacactaacgactataatgtcacagtcttccaaggtgaaaatcgtaaaacttttatgtataaatttccattttatgaaatgtgcgatattaccatgtacatgagcaaacagtacaagttgtggcccccacaaaagtgtttagagaacactggcaccttttgttccaccgctctgcttattacagcgcttgctttggtatgtaccttactttatctcaaatacaaaagcagacgcagttttattgatgaaaagaaaatgccttgattttccgcttgcttgtattcccctggacaatttactctatgtgggatatgctccaggcgggcaagattatacccacaaccttcaaatcaaactttcctggacgttagcgcctgatttctgccagcgcctgcactgcaaatttgatcaaacccagcttcagcttgcctgctccagagatgaccggctcaaccatcgcgcccacaacggactatcgcaacaccactgctaccggactaacatctgccctaaatttaccccaagttcatgcctttgtcaatgactgggcgagcttggacatgtggtggttttccatagcgcttatgtttgtttgccttattattatgtggcttatttgttgcctaaagcgcagacgcgccagaccccccatctataggcctatcattgtgctcaacccacacaatgaaaaaattcatagattggacggtctgaaaccatgttctcttcttttacagtatgattaaatgagacatgattcctcgagttcttatattattgacccttgttgcgcttttctgtgcgtgctctacattggccgcggtcgctcacatcgaagtagattgcatcccacctttcacagtttacctgctttacggatttgtcacccttatcctcatctgcagcctcgtcactgtagtcatcgccttcattcagttcattgactgggtttgtgtgcgcattgcgtacctcaggcaccatccgcaatacagagacaggactatagctgatcttctcagaattctttaattatgaaacggagtgtcatttttgttttgctgattttttgcgccctacctgtgctttgctcccaaacctcagcgcctcccaaaagacatatttcctgcagattcactcaaatatggaacattcccagctgctacaacaaacagagcgatttgtcagaagcctggttatacgccatcatctctgtcatggttttttgcagtaccatttttgccctagccatatatccataccttgacattggctggaatgccatagatgccatgaaccaccctactttcccagtgcccgctgtcataccactgcaacaggttattgccccaatcaatcagcctcgccccccttctcccacccccactgagattagctactttaatttgacaggtggagatgactgaatctctagatctagaattggatggaattaacaccgaacagcgcctactagaaaggcgcaaggcggcgtccgagcgagaacgcctaaaacaagaagttgaagacatggttaacctacaccagtgtaaaagaggtatcttttgtgtggtcaagcaggccaaacttacctacgaaaaaaccactaccggcaaccgcctcagctacaagctacccacccagcgccaaaaactggtgcttatggtgggagaaaaacctatcaccgtcacccagcactcggcagaaacagagggctgcctgcacttcccctatcagggtccagaggacctctgcactcttattaaaaccatgtgtggtattagagatcttattccattcaactaacataaacacacaataaattacttacttaaaatcagtcagcaaatctttgtccagcttattcagcatcacctcctttccttcctcccaactctggtatctcagccgccttttagctgcaaactttctccaaagtttaaatgggatgtcaaattcctcatgttcttgtccctccgcacccactatcttcatattgttgcagatgaaacgcgccagaccgtctgaagacaccttcaaccccgtgtatccatatgacacagaaaccgggcctccaactgtgccctttcttacccctccatttgtttcacccaatggtttccaagaaagtccccctggagttctctctctacgcgtctccgaacctttggacacctcccacggcatgcttgcgcttaaaatgggcagcggtcttaccctagacaaggccggaaacctcacctcccaaaatgtaaccactgttactcagccacttaaaaaaacaaagtcaaacataagtttggacacctccgcaccacttacaattacctcaggcgccctaacagtggcaaccaccgctcctctgatagttactagcggcgctcttagcgtacagtcacaagccccactgaccgtgcaagactccaaactaagcattgctactaaagggcccattacagtgtcagatggaaagctagccctgcaaacatcagcccccctctctggcagtgacagcgacacccttactgtaactgcatcacccccgctaactactgccacgggtagcttgggcattaacatggaagatcctatttatgtaaataatggaaaaataggaattaaaataagcggtcctttgcaagtagcacaaaactccgatacactaacagtagttactggaccaggtgtcaccgttgaacaaaactcccttagaaccaaagttgcaggagctattggttatgattcatcaaacaacatggaaattaaaacgggcggtggcatgcgtataaataacaacttgttaattctagatgtggattacccatttgatgctcaaacaaaactacgtcttaaactggggcagggacccctgtatattaatgcatctcataacttggacataaactataacagaggcctatacctttttaatgcatcaaacaatactaaaaaactggaagttagcataaaaaaatccagtggactaaactttgataatactgccatagctataaatgcaggaaagggtctggagtttgatacaaacacatctgagtctccagatatcaacccaataaaaactaaaattggctctggcattgattacaatgaaaacggtgccatgattactaaacttggagcgggtttaagctttgacaactcaggggccattacaataggaaacaaaaatgatgacaaacttaccctgtggacaaccccagacccatctcctaactgcagaattcattcagataatgactgcaaatttactttggttcttacaaaatgtgggagtcaagtactagctactgtagctgctttggctgtatctggagatctttcatccatgacaggcaccgttgcaagtgttagtatattccttagatttgaccaaaacggtgttctaatggagaactcctcacttaaaaaacattactggaactttagaaatgggaactcaactaatgcaaatccatacacaaatgcagttggatttatgcctaaccttctagcctatccaaaaacccaaagtcaaactgctaaaaataacattgtcagtcaagtttacttgcatggtgataaaactaaacctatgatacttaccattacacttaatggcactagtgaatccacagaaactagcgaggtaagcacttactctatgtcttttacatggtcctgggaaagtggaaaatacaccactgaaacttttgctaccaactcttacaccttctcctacattg

SEQ ID NO: 3001-3009 - skipped (9 entries)

SEQ ID NO: 3010 - DNA, 731 bp, Artificial Sequence
  pHELP_KanV4, Ad2 Region VA-RNA
ggatgttgcccctcctgacgcggtaggagaaggggagggtgccctgcatgtctgccgctgctcttgctcttgccgctgctgaggaggggggcgcatctgccgcagcaccggatgcatctgggaaaagcaaaaaaggggctcgtccctgtttccggaggaatttgcaagcggggtcttgcatgacggggaggcaaacccccgttcgccgcagtccggccggcccgagactcgaaccgggggtcctgcgactcaacccttggaaaataaccctccggctacagggagcgagccacttaatgctttcgctttccagcctaaccgcttacgccgcgcgcggccagtggccaaaaaagctagcgcagcagccgccgcgcctggaaggaagccaaaaggagcgctcccccgttgtctgacgtcgcacacctgggttcgacacgcgggcggtaaccgcatggatcacggcggacggccggatccggggttcgaaccccggtcgtccgccatgatacccttgcgaatttatccaccagaccacggaagagtgcccgcttacaggctctccttttgcacggtctagagcgtcaacgactgcgcacgcctcaccggccagagcgtcccgaccatggagcactttttgccgctgcgcaacatctggaaccgcgtccgcgactttccgcgcgcctccaccaccgccgccggcatcacctggatgtccaggtacatctacggat

SEQ ID NO: 3011 - DNA, 157 bp, Artificial Sequence
  Ad2 VA-RNA region (VA RNA I)
gggcactcttccgtggtctggtggataaattcgcaagggtatcatggcggacgaccggggttcgaaccccggatccggccgtccgccgtgatccatgcggttaccgcccgcgtgtcgaacccaggtgtgcgacgtcagacaacgggggagcgctcct

SEQ ID NO: 3012 - DNA, 158 bp, Artificial Sequence
  Ad2 VA-RNA region (VA RNA II)
ggctcgctccctgtagccggagggttattttccaagggttgagtcgcaggacccccggttcgagtctcgggccggccggactgcggcgaacgggggtttgcctccccgtcatgcaagaccccgcttgcaaattcctccggaaacagggacgagcccct

SEQ ID NO: 3013-3019 - skipped (7 entries)

SEQ ID NO: 3020 - DNA, 3038 bp, Artificial Sequence
  pHELP_KanV4, Ad2 Region E2
gttttagggcggagtaacttgcatgtattgggaattgtagtttttttaaaatgggaagtgacgtatcgtgggaaaacggaagtgaagatttgaggaagttgtgggttttttggctttcgtttctgggcgtaggttcgcgtgcggttttctgggtgttttttgtggactttaaccgttacgtcattttttagtcctatatatactcgctctgtacttggccctttttacactgtgactgattgagctggtgccgtgtcgagtggtgttttttaataggtttttttactggtaaggctgactgttatggctgccgctgtggaagcgctgtatgttgttctggagcgggagggtgctattttgcctaggcaggagggtttttcaggtgtttatgtgtttttctctcctattaattttgttatacctcctatgggggctgtaatgttgtctctacgcctgcgggtatgtattcccccgggctatttcggtcgctttttagcactgaccgatgttaaccaacctgatgtgtttaccgagtcttacattatgactccggacatgaccgaggaactgtcggtggtgctttttaatcacggtgaccagtttttttacggtcacgccggcatggccgtagtccgtcttatgcttataagggttgtttttcctgttgtaagacaggcttctaatgtttaaatgtttttttttttgttattttattttgtgtttaatgcaggaacccgcagacatgtttgagagaaaaatggtgtctttttctgtggtggttccggaacttacctgcctttatctgcatgagcatgactacgatgtgcttgcttttttgcgcgaggctttgcctgattttttgagcagcaccttgcattttatatcgccgcccatgcaacaagcttacataggggctacgctggttagcatagctccgagtatgcgtgtcataatcagtgtgggttcttttgtcatggttcctggcggggaagtggccgcgctggtccgtgcagacctgcacgattatgttcagctggccctgcgaagggacctacgggatcgcggtatttttgttaatgttccgcttttgaatcttatacaggtctgtgaggaacctgaatttttgcaatcatgattcgctgcttgaggctgaaggtggagggcgctctggagcagatttttacaatggccggacttaatattcgggatttgcttagagacatattgataaggtggcgagatgaaaattatttgggcatggttgaaggtgctggaatgtttatagaggagattcaccctgaagggtttagcctttacgtccacttggacgtgagggcagtttgccttttggaagccattgtgcaacatcttacaaatgccattatctgttctttggctgtagagtttgaccacgccaccggaggggagcgcgttcacttaatagatcttcattttgaggttttggataatcttttggaataaaaaaaaaaaaacatggttcttccagctcttcccgctcctcccgtgtgtgactcgcagaacgaatgtgtaggttggctgggtgtggcttattctgcggtggtggatgttatcagggcagcggcgcatgaaggagtttacatagaacccgaagccagggggcgcctggatgctttgagagagtggatatactacaactactacacagagcgagctaagcgacgagaccggagacgcagatctgtttgtcacgcccgcacctggttttgcttcaggaaatatgactacgtccggcgttccatttggcatgacactacgaccaacacgatctcggttgtctcggcgcactccgtacagtagggatcgcctacctccttttgagacagagacccgcgctaccatactggaggatcatccgctgctgcccgaatgtaacactttgacaatgcacaacgtgagttacgtgcgaggtcttccctgcagtgtgggatttacgctgattcaggaatgggttgttccctgggatatggttctgacgcgggaggagcttgtaatcctgaggaagtgtatgcacgtgtgcctgtgttgtgccaacattgatatcatgacgagcatgatgatccatggttacgagtcctgggctctccactgtcattgttccagtcccggttccctgcagtgcatagccggcgggcaggttttggccagctggtttaggatggtggtggatggcgccatgtttaatcagaggtttatatggtaccgggaggtggtgaattacaacatgccaaaagaggtaatgtttatgtccagcgtgtttatgaggggtcgccacttaatctacctgcgcttgtggtatgatggccacgtgggttctgtggtccccgccatgagctttggatacagcgccttgcactgtgggattttgaacaatattgtggtgctgtgctgcagttactgtgctgatttaagtgagatcagggtgcgctgctgtgcccggaggacaaggcgtctcatgctgcgggcggtgcgaatcatcgctgaggagaccactgccatgttgtattcctgcaggacggagcggcggcggcagcagtttattcgcgcgctgctgcagcaccaccgccctatcctgatgcacgattatgactctacccccatgtaggcgtggacttccccttcgccgcccgttgagcaaccgcaagttggacagcagcctgtggctcagcagctggacagcgacatgaacttaagcgagctgcccggggagtttattaatatcactgatgagcgtttggctcgacaggaaaccgtgtggaatataacacctaagaatatgtctgttacccatgatatgatgctttttaaggccagccggggagaaaggactgtgtactctgtgtgttgggagggaggtggcaggttgaatactagggttctgtgagtttgattaaggtacggtgatcaatataagctatgtggtggtggggctatactactgaatgaaaaatgacttgaaattttctgcaattgaaaaataaacacgttgaaacataaca

SEQ ID NO: 3021 - skipped

SEQ ID NO: 3022 - protein, 52 aa, Artificial Sequence
  Ad2 Region E2, 23K endoprotease (C-terminal fragment)
VPNSMLNSPQVQPTLRRNQEQLYSFLERHSPYFRSHSAQIRSATSFCHLKNM

SEQ ID NO: 3023 - protein, 529 aa, Artificial Sequence
  Ad2 Region E2, E2A/DBP
MASREEEQRETTPERGRGAARRPPTMEDVSSPSPSPPPPRAPPKKRLRRRLESEDEEDSSQDALVPRTPSPRPSTSTADLAIASKKKKKRPSPKPERPPSPEVIVDSEEEREDVALQMVGFSNPPVLIKHGKGGKRTVRRLNEDDPVARGMRTQEEKEESSEAESESTVINPLSLPIVSAWEKGMEAARALMDKYHVDNDLKANFKLLPDQVEALAAVCKTWLNEEHRGLQLTFTSNKTFVTMMGRFLQAYLQSFAEVTYKHHEPTGCALWLHRCAEIEGELKCLHGSIMINKEHVIEMDVTSENGQRALKEQSSKAKIVKNRWGRNVVQISNTDARCCVHDAACPANQFSGKSCGMFFSEGAKAQVAFKQIKAFMQALYPNAQTGHGHLLMPLRCECNSKPGHAPFLGRQLPKLTPFALSNAEDLDADLISDKSVLASVHHPALIVFQCCNPVYRNSRAQGGGPNCDFKISAPDLLNALVMVRSLWSENFTELPRMVVPEFKWSTKHQYRNVSLPVAHSDARQNPFDF

SEQ ID NO: 3024 - protein, 805 aa, Artificial Sequence
  Ad2 Region E2, Hexon Assembly (100K)
MESVEKEDSLTAPFEFATTASTDAANAPTTFPVEAPPLEEEEVIIEQDPGFVSEDDEDRSVPTEDKKQDQDDAEANEEQVGRGDQRHGDYLDVGDDVLLKHLQRQCAIICDALQERSDVPLAIADVSLAYERHLFSPRVPPKRQENGTCEPNPRLNFYPVFAVPEVLATYHIFFQNCKIPLSCRANRSRADKQLALRQGAVIPDIASLDEVPKIFEGLGRDEKRAANALQQENSENESHCGVLVELEGDNARLAVLKRSIEVTHFAYPALNLPPKVMSTVMSELIVRRARPLERDANLQEQTEEGLPAVGDEQLARWLETREPADLEERRKLMMAAVLVTVELECMQRFFADPEMQRKLEETLHYTFRQGYVRQACKISNVELCNLVSYLGILHENRLGQNVLHSTLKGEARRDYVRDCVYLFLCYTWQTAMGVWQQCLEERNLKELQKLLKQNLKDLWTAFNERSVAAHLADIIFPERLLKTLQQGLPDFTSQSMLQNFRNFILERSGILPATCCALPSDFVPIKYRECPPPLWGHCYLLQLANYLAYHSDIMEDVSGDGLLECHCRCNLCTPHRSLVCNSQLLSESQIIGTFELQGPSPDEKSAAPGLKLTPGLWTSAYLRKFVPEDYHAHEIRFYEDQSRPPNAELTACVITQGHILGQLQAINKARQEFLLRKGRGVYLDPQSGEELNPIPPPPQPYQQPRALASQDGTQKEAAAAAAATHGRGGILGQSGRGGFGRGGGDDGRLGQPRRSFRGRRGVRRNTVTLGRIPLAGAPEIGNRSQHRYNLRSSGAAGTACSPTQP

SEQ ID NO: 3025 - protein, 228 aa, Artificial Sequence
  Ad2 Region E2, Hexon Assembly (33K)
MAPKKKLQLPPPPPTDEEEYWDSQAEEVLDEEEEMMEDWDSLDEASEAEEVSDETPSPSVAFPSPAPQKLATVPSIATTSAPQAPPALPVRRPNRRWDTTGTRAAPTAPAAAAAAATAAVTQKQRRPDSKTLTKPKKSTAAAAAGGGALRLAPNEPVSTRELRNRIFPTLYAIFQQSRGQEQELKIKNRSLRSLTRSCLYHKSEDQLRRTLEDAEALFSKYCALTLKD

SEQ ID NO: 3026 - protein, 195 aa, Artificial Sequence
  Ad2 Region E2, Hexon Assembly (22K)
MAPKKKLQLPPPPPTDEEEYWDSQAEEVLDEEEEMMEDWDSLDEASEAEEVSDETPSPSVAFPSPAPQKLATVPSIATTSAPQAPPALPVRRPNRRWDTTGTRAGKSKQPPPLAQEQQQRQGYRSWRGHKNAIVACLQDCGGNISFARRFLLYHHGVAFPRNILHYYRHLYSPYCTGGSGSGSNSSGHTEAKATG

SEQ ID NO: 3027 - protein, 125 aa, Artificial Sequence
  Ad2 Region E2, Hexon-associated precursor
MSKEIPTPYMWSYQPQMGLAAGAAQDYSTRINYMSAGPHMISRVNGIRAHRNRILLEQAAITTTPRNNLNPRSWPAALVYQESPAPTTVVLPRDAQAEVQMTNSGAQLAGGFRHRVRSPGRFRAE

SEQ ID NO: 3028-3029 - skipped (2 entries)

SEQ ID NO: 3030 - DNA, 5343 bp, Artificial Sequence
  pHELP_KanV4, Ad2 Region E4
ggtacccaactccatgcttaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactaggagacactttcaataaaggcaaatgtttttatttgtacactctcgggtgattatttaccccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggtgcatgcccaggctttgagttgcactcgcaccgtagtggcatcagaaggtgaccgtgcccggtctgggcgttaggatacagcgcctgcatgaaagccttgatctgcttaaaagccacctgagcctttgcgccttcagagaagaacatgccgcaagacttgccggaaaactgattggccggacaggccgcgtcatgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgctcccgtgtagacacttaagctcgccttcgatctcagcgcagcggtgcagccacaacgcgcagcccgtgggctcgtggtgcttgtaggttacctctgcaaacgactgcaggtacgcctgcaggaatcgccccatcatcgtcacaaaggtcttgttgctggtgaaggtcagctgcaacccgcggtgctcctcgtttagccaggtcttgcatacggccgccagagcttccacttggtcaggcagtagcttgaagtttgcctttagatcgttatccacgtggtacttgtccatcaacgcgcgcgcagcctccatgcccttctcccacgcagacacgatcggcaggctcagcgggtttatcaccgtgctttcactttccgcttcactggactcttccttttcctcttgcgtccgcataccccgcgccactgggtcgtcttcattcagccgccgcaccgtgcgcttacctcccttgccgtgcttgattagcaccggtgggttgctgaaacccaccatttgtagcgccacatcttctctttcttcctcgctgtccacgatcacctctggggatggcgggcgctcgggcttgggagaggggcgcttctttttctttttggacgcaatggccaaatccgccgtcgaggtcgatggccgcgggctgggtgtgcgcggcaccagcgcatcttgtgacgagtcttcttcgtcctcggactcgagacgccgcctcagccgcttttttgggggcgcgcggggaggcggcggcgacggcgacggggacgacacgtcctccatggttggtggacgtcgcgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctaccaccttccccgtcgaggcacccccgcttgaggaggaggaagtgattatcgagcaggacccaggttttgtaagcgaagacgacgaggatcgctcagtaccaacagaggataaaaagcaagaccaggacgacgcagaggcaaacgaggaacaagtcgggcggggggaccaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctgttctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcgacgaagtgccaaaaatctttgagggtcttggacgcgacgagaaacgcgcggcaaacgctctgcaacaagaaaacagcgaaaatgaaagtcactgtggagtgctggtggaacttgagggtgacaacgcgcgcctagccgtgctgaaacgcagcatcgaggtcacccactttgcctacccggcacttaacctaccccccaaggttatgagcacagtcatgagcgagctgatcgtgcgccgtgcacgacccctggagagggatgcaaacttgcaagaacaaaccgaggagggcctacccgcagttggcgatgagcagctggcgcgctggcttgagacgcgcgagcctgccgacttggaggagcgacgcaagctaatgatggccgcagtgcttgttaccgtggagcttgagtgcatgcagcggttctttgctgacccggagatgcagcgcaagctagaggaaacgttgcactacacctttcgccagggctacgtgcgccaggcctgcaaaatttccaacgtggagctctgcaacctggtctcctaccttggaattttgcacgaaaaccgcctcgggcaaaacgtgcttcattccacgctcaagggcgaggcgcgccgcgactacgtccgcgactgcgtttacttatttctgtgctacacctggcaaacggccatgggcgtgtggcagcaatgcctggaggagcgcaacctaaaggagctgcagaagctgctaaagcaaaacttgaaggacctatggacggccttcaacgagcgctccgtggccgcgcacctggcggacattatcttccccgaacgcctgcttaaaaccctgcaacagggtctgccagacttcaccagtcaaagcatgttgcaaaactttaggaactttatcctagagcgttcaggaattctgcccgccacctgctgtgcgcttcctagcgactttgtgcccattaagtaccgtgaatgccctccgccgctttggggtcactgctaccttctgcagctagccaactaccttgcctaccactccgacatcatggaagacgtgagcggtgacggcctactggagtgtcactgtcgctgcaacctatgcaccccgcaccgctccctggtctgcaattcgcaactgcttagcgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacatccttggccaattgcaagccatcaacaaagcccgccaagagtttctgctacgaaagggacggggggtttacctggacccccagtccggcgaggagctcaacccaatccccccgccgccgcagccctatcagcagccgcgggcccttgcttcccaggatggcacccaaaaagaagctgcagctgccgccgccgccacccacggacgaggaggaatactgggacagtcaggcagaggaggttttggacgaggaggaggagatgatggaagactgggacagcctagacgaagcttccgaggccgaagaggtgtcagacgaaacaccgtcaccctcggtcgcattcccctcgccggcgccccagaaattggcaaccgttcccagcatcgctacaacctccgctcctcaggcgccgccggcactgcctgttcgccgacccaaccgtagatgggacaccactggaaccagggccggtaagtctaagcagccgccgccgttagcccaagagcaacaacagcgccaaggctaccgctcgtggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccctactgcaccggcggcagcggcagcggcagcaacagcagcggtcacacagaagcaaaggcgaccggatagcaagactctgacaaagcccaagaaatccacagcggcggcagcagcaggaggaggagcgctgcgtctggcgcccaacgaacccgtatcgacccgcgagcttagaaataggatttttcccactctgtatgctatatttcaacaaagcaggggccaagaacaagagctgaaaataaaaaacaggtctctgcgctccctcacccgcagctgcctgtatcacaaaagcgaagatcagcttcggcgcacgctggaagacgcggaggctctcttcagcaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcctcgaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggc

SEQ ID NO: 3031 - skipped

SEQ ID NO: 3032 - protein, 128 aa, Artificial Sequence; identical to SEQ ID NO: 2032
  Ad2 Region E4, ORF1

SEQ ID NO: 3033 - protein, 130 aa, Artificial Sequence
  Ad2 Region E4, ORF2
MFERKMVSFSVVVPELTCLYLHEHDYDVLAFLREALPDFLSSTLHFISPPMQQAYIGATLVSIAPSMRVIISVGSFVMVPGGEVAALVRADLHDYVQLALRRDLRDRGIFVNVPLLNLIQVCEEPEFLQS

SEQ ID NO: 3034 - protein, 116 aa, Artificial Sequence
  Ad2 Region E4, ORF3
MIRCLRLKVEGALEQIFTMAGLNIRDLLRDILIRWRDENYLGMVEGAGMFIEEIHPEGFSLYVHLDVRAVCLLEAIVQHLTNAIICSLAVEFDHATGGERVHLIDLHFEVLDNLLE

SEQ ID NO: 3035 - protein, 114 aa, Artificial Sequence
  Ad2 Region E4, ORF4
MVLPALPAPPVCDSQNECVGWLGVAYSAVVDVIRAAAHEGVYIEPEARGRLDALREWIYYNYYTERAKRRDRRRRSVCHARTWFCFRKYDYVRRSIWHDTTTNTISVVSAHSVQ

SEQ ID NO: 3036 - protein, 294 aa, Artificial Sequence; identical to SEQ ID NO: 2036
  Ad2 Region E4, ORF6

SEQ ID NO: 3037 - protein, 150 aa, Artificial Sequence
  Ad2 Region E4, ORF6/7
MTTSGVPFGMTLRPTRSRLSRRTPYSRDRLPPFETETRATILEDHPLLPECNTLTMHNAWTSPSPPVEQPQVGQQPVAQQLDSDMNLSELPGEFINITDERLARQETVWNITPKNMSVTHDMMLFKASRGERTVYSVCWEGGGRLNTRVL

SEQ ID NO: 3038-9899 - skipped (6862 entries)

SEQ ID NO: 9900 - DNA, 7638 bp, Artificial Sequence
  AAV-CBA-ABCD1-WPRE, full plasmid
ggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctcagatctgaattcggtacctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaagataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggactagagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctgaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcccccccccccccccctgcagcctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccaggctgcagggggggggggggg

SEQ ID NO: 9901 - DNA, 143 bp, Artificial Sequence
  AAV-CBA-ABCD1-WPRE, 5'ITR
ggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 9902-9904 - skipped (3 entries)

SEQ ID NO: 9905 - DNA, 366 bp, Artificial Sequence
  AAV-CBA-ABCD1-WPRE, CMV Enhancer
ctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgg

SEQ ID NO: 9906 - skipped

SEQ ID NO: 9907 - DNA, 278 bp, Artificial Sequence; identical to SEQ ID NO: 10
  AAV-CBA-ABCD1-WPRE, CBA Promoter

SEQ ID NO: 9908 - DNA, 93 bp, Artificial Sequence; identical to SEQ ID NO: 11
  AAV-CBA-ABCD1-WPRE, beta actin Exon

SEQ ID NO: 9909 - DNA, 155 bp, Artificial Sequence
  AAV-CBA-ABCD1-WPRE, Chimeric Intron
gtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacag

SEQ ID NO: 9910 - DNA, 117 bp, Artificial Sequence
  AAV-CBA-ABCD1-WPRE, hABCD1 5' UTR
tttccagttgcctagacaacaggcccagggtcagagcaacaatccttccagccacctgcctcaactgctgccccaggcaccagccccagtccctacgcggcagccagcccaggtgac

SEQ ID NO: 9911 - skipped

SEQ ID NO: 9912 - DNA, 2238 bp, Artificial Sequence; identical to SEQ ID NO: 204
  AAV-CBA-ABCD1-WPRE, ABCD1

SEQ ID NO: 9913 - DNA, 49 bp, Artificial Sequence
  AAV-CBA-ABCD1-WPRE, hABCD1 3' UTR
cacaaccgtccccggcccctgccccgcccccaagctcggatcacatgaa

SEQ ID NO: 9914 - DNA, 197 bp, Artificial Sequence
  AAV-CBA-ABCD1-WPRE, SV40 pA
gatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggtttttta

SEQ ID NO: 9915 - skipped

SEQ ID NO: 9916 - DNA, 208 bp, Artificial Sequence
  AAV-CBA-ABCD1-WPRE, bGHpA
ctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctgggga

SEQ ID NO: 9917 - skipped

SEQ ID NO: 9918 - DNA, 143 bp, Artificial Sequence
  AAV-CBA-ABCD1-WPRE, 3'ITR
aggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcc

SEQ ID NO: 9919-9934 - skipped (16 entries)

SEQ ID NO: 9935 - DNA, 434 bp, Artificial Sequence; identical to SEQ ID NO: 206
  AAV-CBA-ABCD1-WPRE, Total polyA

SEQ ID NO: 9936-9949 - skipped (14 entries)

SEQ ID NO: 9950 - DNA, 4780 bp, Artificial Sequence
  AAV-CBA-ABCD1-WPRE, ITR-ITR
ggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctcagatctgaattcggtacctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaagataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggactagagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctgaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcc

SEQ ID NO: 9951-9959 - skipped (9 entries)

SEQ ID NO: 9960 - DNA, 4782 bp, Artificial Sequence
  AAV-CBA-ABCD1-WPRE, rAAV vector genome
tggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctcagatctgaattcggtacctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaagataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggactagagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctgaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcca

SEQ ID NO: 9961-9970 - skipped (10 entries)

SEQ ID NO: 9971 - DNA, 3 bp, Artificial Sequence
  AAV-CBA-ABCD1-WPRE, Terminator 1
tga

SEQ ID NO: 9972-9974 - skipped (3 entries)

SEQ ID NO: 9975 - DNA, 590 bp, Artificial Sequence
  AAV-CBA-ABCD1-WPRE, WPRE
taatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgc

SEQ ID NO: 9976-9984 - skipped (9 entries)

SEQ ID NO: 9985 - DNA, 54 bp, Artificial Sequence
  AAV-CBA-ABCD1-WPRE, Rabbit beta-globin exon
ctcctgggcaacgtgctggttattgtgctgtctcatcattttggcaaagaattc

SEQ ID NO: 9986-9999 - skipped (14 entries)

SEQ ID NO: 10000 - DNA, 7638 bp, Artificial Sequence
  AAV-CBA-ABCD1-WPRE (Xinact), full plasmid
ggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctcagatctgaattcggtacctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaagataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggactagagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctgaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcccccccccccccccctgcagcctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccaggctgcagggggggggggggg

SEQ ID NO: 10001 - DNA, 143 bp, Artificial Sequence; identical to SEQ ID NO: 9901
  AAV-CBA-ABCD1-WPRE (Xinact), 5'ITR

SEQ ID NO: 10002-10004 - skipped (3 entries)

SEQ ID NO: 10005 - DNA, 366 bp, Artificial Sequence; identical to SEQ ID NO: 9905
  AAV-CBA-ABCD1-WPRE (Xinact), CMV Enhancer

SEQ ID NO: 10006 - skipped

SEQ ID NO: 10007 - DNA, 278 bp, Artificial Sequence; identical to SEQ ID NO: 10
  AAV-CBA-ABCD1-WPRE (Xinact), CBA Promoter

SEQ ID NO: 10008 - DNA, 93 bp, Artificial Sequence; identical to SEQ ID NO: 11
  AAV-CBA-ABCD1-WPRE (Xinact), beta-actin Exon

SEQ ID NO: 10009 - DNA, 155 bp, Artificial Sequence; identical to SEQ ID NO: 9909
  AAV-CBA-ABCD1-WPRE (Xinact), Chimeric Intron

SEQ ID NO: 10010 - DNA, 117 bp, Artificial Sequence; identical to SEQ ID NO: 9910
  AAV-CBA-ABCD1-WPRE (Xinact), hABCD1 5' UTR

SEQ ID NO: 10011 - skipped

SEQ ID NO: 10012 - DNA, 2238 bp, Artificial Sequence; identical to SEQ ID NO: 204
  AAV-CBA-ABCD1-WPRE (Xinact), ABCD1

SEQ ID NO: 10013 - DNA, 49 bp, Artificial Sequence; identical to SEQ ID NO: 9913
  AAV-CBA-ABCD1-WPRE (Xinact), hABCD1 3' UTR

SEQ ID NO: 10014 - DNA, 197 bp, Artificial Sequence; identical to SEQ ID NO: 9914
  AAV-CBA-ABCD1-WPRE (Xinact), SV40 pA

SEQ ID NO: 10015 - skipped

SEQ ID NO: 10016 - DNA, 208 bp, Artificial Sequence; identical to SEQ ID NO: 9916
  AAV-CBA-ABCD1-WPRE (Xinact), bGHpA

SEQ ID NO: 10017 - skipped

SEQ ID NO: 10018 - DNA, 143 bp, Artificial Sequence; identical to SEQ ID NO: 9918
  AAV-CBA-ABCD1-WPRE (Xinact), 3'ITR

SEQ ID NO: 10019-10034 - skipped (16 entries)

SEQ ID NO: 10035 - DNA, 434 bp, Artificial Sequence; identical to SEQ ID NO: 206
  AAV-CBA-ABCD1-WPRE (Xinact), Total polyA

SEQ ID NO: 10036-10049 - skipped (14 entries)

SEQ ID NO: 10050 - DNA, 4780 bp, Artificial Sequence
  AAV-CBA-ABCD1-WPRE (Xinact), ITR-ITR
ggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctcagatctgaattcggtacctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaagataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggactagagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctgaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcc

SEQ ID NO: 10051-10059 - skipped (9 entries)

SEQ ID NO: 10060 - DNA, 4782 bp, Artificial Sequence
  AAV-CBA-ABCD1-WPRE (Xinact), rAAV vector genome
tggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctcagatctgaattcggtacctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaagataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggactagagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctgaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcca

SEQ ID NO: 10061-10070 - skipped (10 entries)

SEQ ID NO: 10071 - DNA, 3 bp, Artificial Sequence
  AAV-CBA-ABCD1-WPRE (Xinact), Terminator 1
tga

SEQ ID NO: 10072-10074 - skipped (3 entries)

SEQ ID NO: 10075 - DNA, 590 bp, Artificial Sequence
  AAV-CBA-ABCD1-WPRE (Xinact), WPRE (X inact)
taatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgc

SEQ ID NO: 10076-10084 - skipped (9 entries)

SEQ ID NO: 10085 - DNA, 54 bp, Artificial Sequence; identical to SEQ ID NO: 9985
  AAV-CBA-ABCD1-WPRE (Xinact), Rabbit beta-globin exon

SEQ ID NO: 10086-10099 - skipped (14 entries)

SEQ ID NO: 10100 - DNA, 6815 bp, Artificial Sequence
  pSBT101, full plasmid
ggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctcagatctgaattcggtacctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctgaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcccgttccatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatggaac

SEQ ID NO: 10101 - DNA, 143 bp, Artificial Sequence; identical to SEQ ID NO: 9901
  pSBT101, 5'ITR

SEQ ID NO: 10102-10104 - skipped (3 entries)

SEQ ID NO: 10105 - DNA, 366 bp, Artificial Sequence; identical to SEQ ID NO: 9905
  pSBT101, CMV Enhancer

SEQ ID NO: 10106 - skipped

SEQ ID NO: 10107 - DNA, 278 bp, Artificial Sequence; identical to SEQ ID NO: 10
  pSBT101, CBA Promoter

SEQ ID NO: 10108 - DNA, 93 bp, Artificial Sequence; identical to SEQ ID NO: 11
  pSBT101, beta-actin Exon

SEQ ID NO: 10109 - DNA, 155 bp, Artificial Sequence; identical to SEQ ID NO: 9909
  pSBT101, Chimeric Intron

SEQ ID NO: 10110 - DNA, 117 bp, Artificial Sequence; identical to SEQ ID NO: 9910
  pSBT101, hABCD1 5' UTR

SEQ ID NO: 10111 - skipped

SEQ ID NO: 10112 - DNA, 2238 bp, Artificial Sequence; identical to SEQ ID NO: 204
  pSBT101, hABCD1

SEQ ID NO: 10113 - DNA, 49 bp, Artificial Sequence; identical to SEQ ID NO: 9913
  pSBT101, hABCD1 3' UTR

SEQ ID NO: 10114 - DNA, 197 bp, Artificial Sequence; identical to SEQ ID NO: 9914
  pSBT101, SV40 pA

SEQ ID NO: 10115 - skipped

SEQ ID NO: 10116 - DNA, 208 bp, Artificial Sequence; identical to SEQ ID NO: 9916
  pSBT101, bGHpA

SEQ ID NO: 10117 - skipped

SEQ ID NO: 10118 - DNA, 143 bp, Artificial Sequence; identical to SEQ ID NO: 9918
  pSBT101, 3'ITR

SEQ ID NO: 10119-10134 - skipped (16 entries)

SEQ ID NO: 10135 - DNA, 434 bp, Artificial Sequence; identical to SEQ ID NO: 206
  pSBT101, Total polyA

SEQ ID NO: 10136-10149 - skipped (14 entries)

SEQ ID NO: 10150 - DNA, 4178 bp, Artificial Sequence
  pSBT101, ITR-ITR
ggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctcagatctgaattcggtacctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctgaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcc

SEQ ID NO: 10151-10159 - skipped (9 entries)

SEQ ID NO: 10160 - DNA, 4180 bp, Artificial Sequence
  pSBT101, rAAV vector genome
tggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctcagatctgaattcggtacctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctgaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcca

SEQ ID NO: 10161-10170 - skipped (10 entries)

SEQ ID NO: 10171 - DNA, 3 bp, Artificial Sequence
  pSBT101, Terminator 1
tga

SEQ ID NO: 10172-10184 - skipped (13 entries)

SEQ ID NO: 10185 - DNA, 54 bp, Artificial Sequence; identical to SEQ ID NO: 9985
  pSBT101, Rabbit beta-globin exon

SEQ ID NO: 10186-10199 - skipped (14 entries)

SEQ ID NO: 10200 - DNA, 6840 bp, Artificial Sequence
  AAV-CBA-ABCD1 [no WPRE], full plasmid
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctgaattcggtaccctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgactcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccacccccccccccccctgcagcctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccaggctgcagggggggggggggg

SEQ ID NO: 10201 - DNA, 145 bp, Artificial Sequence; identical to SEQ ID NO: 601
  AAV-CBA-ABCD1 [no WPRE], 5'ITR

SEQ ID NO: 10202-10204 - skipped (3 entries)

SEQ ID NO: 10205 - DNA, 366 bp, Artificial Sequence
  AAV-CBA-ABCD1 [no WPRE], CMV Enhancer
ctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgg

SEQ ID NO: 10206 - skipped

SEQ ID NO: 10207 - DNA, 278 bp, Artificial Sequence; identical to SEQ ID NO: 10
  AAV-CBA-ABCD1 [no WPRE], CBA Promoter

SEQ ID NO: 10208 - DNA, 94 bp, Artificial Sequence
  AAV-CBA-ABCD1 [no WPRE], beta-actin Exon
ggagtcgctgcgacgctgccttcgccccgtgccccgctccgccgccgcctcgcgccgcccgccccggctctgactgaccgcgttactcccacag

SEQ ID NO: 10209 - DNA, 155 bp, Artificial Sequence; identical to SEQ ID NO: 9909
  AAV-CBA-ABCD1 [no WPRE], Chimeric Intron

SEQ ID NO: 10210-10211 - skipped (2 entries)

SEQ ID NO: 10212 - DNA, 2238 bp, Artificial Sequence; identical to SEQ ID NO: 204
  AAV-CBA-ABCD1 [no WPRE], hABCD1

SEQ ID NO: 10213 - skipped

SEQ ID NO: 10214 - DNA, 197 bp, Artificial Sequence; identical to SEQ ID NO: 9914
  AAV-CBA-ABCD1 [no WPRE], SV40 pA

SEQ ID NO: 10215 - skipped

SEQ ID NO: 10216 - DNA, 208 bp, Artificial Sequence; identical to SEQ ID NO: 9916
  AAV-CBA-ABCD1 [no WPRE], bGHpA

SEQ ID NO: 10217 - skipped

SEQ ID NO: 10218 - DNA, 144 bp, Artificial Sequence; identical to SEQ ID NO: 612
  AAV-CBA-ABCD1 [no WPRE], 3'ITR

SEQ ID NO: 10219-10234 - skipped (16 entries)

SEQ ID NO: 10235 - DNA, 434 bp, Artificial Sequence; identical to SEQ ID NO: 206
  AAV-CBA-ABCD1 [no WPRE], Total polyA

SEQ ID NO: 10236-10249 - skipped (14 entries)

SEQ ID NO: 10250 - DNA, 3982 bp, Artificial Sequence; identical to SEQ ID NO: 400
  AAV-CBA-ABCD1 [no WPRE], ITR-ITR

SEQ ID NO: 10251-10259 - skipped (9 entries)

SEQ ID NO: 10260 - DNA, 3981 bp, Artificial Sequence
  AAV-CBA-ABCD1 [no WPRE], rAAV vector genome
tggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctgaattcggtaccctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgacgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgactcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggcca

SEQ ID NO: 10261-10270 - skipped (10 entries)

SEQ ID NO: 10271 - DNA, 3 bp, Artificial Sequence
  AAV-CBA-ABCD1 [no WPRE], Terminator 1
tga

SEQ ID NO: 10272-10284 - skipped (13 entries)

SEQ ID NO: 10285 - DNA, 54 bp, Artificial Sequence; identical to SEQ ID NO: 9985
  AAV-CBA-ABCD1 [no WPRE], Rabbit beta-globin exon

SEQ ID NO: 10286-10499 - skipped (214 entries)

SEQ ID NO: 10500 - DNA, 6124 bp, Artificial Sequence
  pOB1005, full plasmid
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctcgcgtattgggatagcttccaccatgccggtgctctctaggccccggccctggcgggggaacacgctgaagcgcacggccgtgctcctggccctcgcggcctatggagcccacaaagtctaccccttggtgcgccagtgcctggccccggctaggggtcttcaggcgcccgccggggagcccacgcaggaggcctccggggtcgcggcggccaaagctggcatgaaccgggtattcctgcagcggctcctctggctcctgcggctgctgttcccccgggtcctctgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgcggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctctggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgataactcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgacgcggaacccctatttgtttatttttctaaatacattcaaatatgtatccgctcatgagacaataaccctgataaatgcttcaataatattgaaaaaggaagagtatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccctgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcctgcaggcag

SEQ ID NO: 10501 - DNA, 130 bp, Artificial Sequence
  pOB1005, 5'ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 10502-10504 - skipped (3 entries)

SEQ ID NO: 10505 - DNA, 366 bp, Artificial Sequence; identical to SEQ ID NO: 9905
  pOB1005, CMV Enhancer

SEQ ID NO: 10506 - skipped

SEQ ID NO: 10507 - DNA, 278 bp, Artificial Sequence; identical to SEQ ID NO: 10
  pOB1005, CBA Promoter

SEQ ID NO: 10508 - DNA, 93 bp, Artificial Sequence; identical to SEQ ID NO: 11
  pOB1005, beta-actin Exon

SEQ ID NO: 10509 - DNA, 155 bp, Artificial Sequence; identical to SEQ ID NO: 9909
  pOB1005, Chimeric Intron

SEQ ID NO: 10510 - skipped

SEQ ID NO: 10511 - DNA, 10 bp, Artificial Sequence
  pOB1005, Kozak Sequence
tccaccatgc

SEQ ID NO: 10512 - DNA, 2241 bp, Artificial Sequence
  pOB1005, hABCD1/9nt
atgccggtgctctctaggccccggccctggcgggggaacacgctgaagcgcacggccgtgctcctggccctcgcggcctatggagcccacaaagtctaccccttggtgcgccagtgcctggccccggctaggggtcttcaggcgcccgccggggagcccacgcaggaggcctccggggtcgcggcggccaaagctggcatgaaccgggtattcctgcagcggctcctctggctcctgcggctgctgttcccccgggtcctctgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgcggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctctggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgataa

SEQ ID NO: 10513 - skipped

SEQ ID NO: 10514 - DNA, 135 bp, Artificial Sequence
  pOB1005, SV40 pA
gatccagacatgataagatacattgatgagtttggacaaaccacaactagaatgcagtgaaaaaaatgctttatttgtgaaatttgtgatgctattgctttatttgtaaccattataagctgcaataaacaagtt

SEQ ID NO: 10515-10517 - skipped (3 entries)

SEQ ID NO: 10518 - DNA, 130 bp, Artificial Sequence
  pOB1005, 3'ITR
aggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 10519-10549 - skipped (31 entries)

SEQ ID NO: 10550 - DNA, 3691 bp, Artificial Sequence
  pOB1005, ITR-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctcgcgtattgggatagcttccaccatgccggtgctctctaggccccggccctggcgggggaacacgctgaagcgcacggccgtgctcctggccctcgcggcctatggagcccacaaagtctaccccttggtgcgccagtgcctggccccggctaggggtcttcaggcgcccgccggggagcccacgcaggaggcctccggggtcgcggcggccaaagctggcatgaaccgggtattcctgcagcggctcctctggctcctgcggctgctgttcccccgggtcctctgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgcggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctctggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgataactcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 10551-10559 - skipped (9 entries)

SEQ ID NO: 10560 - DNA, 3719 bp, Artificial Sequence
  pOB1005, rAAV vector genome
tggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctcgcgtattgggatagcttccaccatgccggtgctctctaggccccggccctggcgggggaacacgctgaagcgcacggccgtgctcctggccctcgcggcctatggagcccacaaagtctaccccttggtgcgccagtgcctggccccggctaggggtcttcaggcgcccgccggggagcccacgcaggaggcctccggggtcgcggcggccaaagctggcatgaaccgggtattcctgcagcggctcctctggctcctgcggctgctgttcccccgggtcctctgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgcggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctctggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgataactcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcca

SEQ ID NO: 10561-10570 - skipped (10 entries)

SEQ ID NO: 10571 - DNA, 3 bp, Artificial Sequence
  pOB1005, Terminator 1
tga

SEQ ID NO: 10572 - DNA, 3 bp, Artificial Sequence
  pOB1005, Terminator 2
taa

SEQ ID NO: 10573-10584 - skipped (12 entries)

SEQ ID NO: 10585 - DNA, 54 bp, Artificial Sequence; identical to SEQ ID NO: 9985
  pOB1005, Rabbit beta-globin exon

SEQ ID NO: 10586-10999 - skipped (414 entries)

SEQ ID NO: 11000 - DNA, 6598 bp, Artificial Sequence
  pOB1010, full plasmid
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgacgcggaacccctatttgtttatttttctaaatacattcaaatatgtatccgctcatgagacaataaccctgataaatgcttcaataatattgaaaaaggaagagtatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccctgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcctgcaggcag

SEQ ID NO: 11001 - DNA, 130 bp, Artificial Sequence; identical to SEQ ID NO: 10501
  pOB1010, 5'ITR

SEQ ID NO: 11002-11004 - skipped (3 entries)

SEQ ID NO: 11005 - DNA, 366 bp, Artificial Sequence; identical to SEQ ID NO: 9905
  pOB1010, CMV Enhancer

SEQ ID NO: 11006 - skipped

SEQ ID NO: 11007 - DNA, 278 bp, Artificial Sequence; identical to SEQ ID NO: 10
  pOB1010, CBA Promoter

SEQ ID NO: 11008 - DNA, 93 bp, Artificial Sequence; identical to SEQ ID NO: 11
  pOB1010, beta-actin Exon

SEQ ID NO: 11009 - DNA, 155 bp, Artificial Sequence; identical to SEQ ID NO: 9909
  pOB1010, Chimeric Intron

SEQ ID NO: 11010 - DNA, 117 bp, Artificial Sequence; identical to SEQ ID NO: 9910
  pOB1010, hABCD1 5' UTR

SEQ ID NO: 11011 - skipped

SEQ ID NO: 11012 - DNA, 2238 bp, Artificial Sequence; identical to SEQ ID NO: 204
  pOB1010, hABCD1

SEQ ID NO: 11013 - DNA, 49 bp, Artificial Sequence; identical to SEQ ID NO: 9913
  pOB1010, hABCD1 3' UTR

SEQ ID NO: 11014 - DNA, 197 bp, Artificial Sequence; identical to SEQ ID NO: 9914
  pOB1010, SV40 pA

SEQ ID NO: 11015 - skipped

SEQ ID NO: 11016 - DNA, 208 bp, Artificial Sequence; identical to SEQ ID NO: 9916
  pOB1010, bGH pA

SEQ ID NO: 11017 - skipped

SEQ ID NO: 11018 - DNA, 130 bp, Artificial Sequence; identical to SEQ ID NO: 10518
  pOB1010, 3'ITR

SEQ ID NO: 11019-11034 - skipped (16 entries)

SEQ ID NO: 11035 - DNA, 434 bp, Artificial Sequence; identical to SEQ ID NO: 206
  pOB1010, Total polyA

SEQ ID NO: 11036-11049 - skipped (14 entries)

SEQ ID NO: 11050 - DNA, 4165 bp, Artificial Sequence
  pOB1010, ITR-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 11051-11059 - skipped (9 entries)

SEQ ID NO: 11060 - DNA, 4193 bp, Artificial Sequence
  pOB1010, rAAV vector genome
tggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcca

SEQ ID NO: 11061-11070 - skipped (10 entries)

SEQ ID NO: 11071 - DNA, 3 bp, Artificial Sequence
  pOB1010, Terminator 1
tga

SEQ ID NO: 11072-11084 - skipped (13 entries)

SEQ ID NO: 11085 - DNA, 54 bp, Artificial Sequence; identical to SEQ ID NO: 9985
  pOB1010, Rabbit beta-globin exon

SEQ ID NO: 11086-11099 - skipped (14 entries)

SEQ ID NO: 11100 - DNA, 6353 bp, Artificial Sequence
  pOB1011, full plasmid
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagattcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgacgcggaacccctatttgtttatttttctaaatacattcaaatatgtatccgctcatgagacaataaccctgataaatgcttcaataatattgaaaaaggaagagtatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccctgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcctgcaggcag

SEQ ID NO: 11101 - DNA, 130 bp, Artificial Sequence; identical to SEQ ID NO: 10501
  pOB1011, 5'ITR

SEQ ID NO: 11102-11104 - skipped (3 entries)

SEQ ID NO: 11105 - DNA, 366 bp, Artificial Sequence; identical to SEQ ID NO: 9905
  pOB1011, CMV Enhancer

SEQ ID NO: 11106 - skipped

SEQ ID NO: 11107 - DNA, 278 bp, Artificial Sequence; identical to SEQ ID NO: 10
  pOB1011, CBA Promoter

SEQ ID NO: 11108 - DNA, 93 bp, Artificial Sequence; identical to SEQ ID NO: 11
  pOB1011, beta-actin Exon

SEQ ID NO: 11109 - DNA, 155 bp, Artificial Sequence; identical to SEQ ID NO: 9909
  pOB1011, Chimeric Intron

SEQ ID NO: 11110 - DNA, 117 bp, Artificial Sequence; identical to SEQ ID NO: 9910
  pOB1011, hABCD1 5' UTR

SEQ ID NO: 11111 - skipped

SEQ ID NO: 11112 - DNA, 2238 bp, Artificial Sequence; identical to SEQ ID NO: 204
  pOB1011, hABCD1

SEQ ID NO: 11113 - DNA, 49 bp, Artificial Sequence; identical to SEQ ID NO: 9913
  pOB1011, hABCD1 3' UTR

SEQ ID NO: 11114-11115 - skipped (2 entries)

SEQ ID NO: 11116 - DNA, 208 bp, Artificial Sequence; identical to SEQ ID NO: 9916
  pOB1011, bGH pA

SEQ ID NO: 11117 - skipped

SEQ ID NO: 11118 - DNA, 130 bp, Artificial Sequence; identical to SEQ ID NO: 10518
  pOB1011, 3'ITR

SEQ ID NO: 11119-11149 - skipped (31 entries)

SEQ ID NO: 11150 - DNA, 3920 bp, Artificial Sequence
  pOB1011, ITR-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagattcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 11151-11159 - skipped (9 entries)

SEQ ID NO: 11160 - DNA, 3948 bp, Artificial Sequence
  pOB1011, rAAV vector genome
tggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagattcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcca

SEQ ID NO: 11161-11170 - skipped (10 entries)

SEQ ID NO: 11171 - DNA, 3 bp, Artificial Sequence
  pOB1011, Terminator 1
tga

SEQ ID NO: 11172-11184 - skipped (13 entries)

SEQ ID NO: 11185 - DNA, 54 bp, Artificial Sequence; identical to SEQ ID NO: 9985
  pOB1011, Rabbit beta-globin exon

SEQ ID NO: 11186-11199 - skipped (14 entries)

SEQ ID NO: 11200 - DNA, 6429 bp, Artificial Sequence
  pOB1012, full plasmid
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctcgcgtattgggatagcttccaccatgccggtgctctctaggccccggccctggcgggggaacacgctgaagcgcacggccgtgctcctggccctcgcggcctatggagcccacaaagtctaccccttggtgcgccagtgcctggccccggctaggggtcttcaggcgcccgccggggagcccacgcaggaggcctccggggtcgcggcggccaaagctggcatgaaccgggtattcctgcagcggctcctctggctcctgcggctgctgttcccccgggtcctctgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgcggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctctggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgataactcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgacgcggaacccctatttgtttatttttctaaatacattcaaatatgtatccgctcatgagacaataaccctgataaatgcttcaataatattgaaaaaggaagagtatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccctgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcctgcaggcag

SEQ ID NO: 11201 - DNA, 130 bp, Artificial Sequence; identical to SEQ ID NO: 10501
  pOB1012, 5'ITR

SEQ ID NO: 11202-11204 - skipped (3 entries)

SEQ ID NO: 11205 - DNA, 366 bp, Artificial Sequence; identical to SEQ ID NO: 9905
  pOB1012, CMV Enhancer

SEQ ID NO: 11206 - skipped

SEQ ID NO: 11207 - DNA, 278 bp, Artificial Sequence; identical to SEQ ID NO: 10
  pOB1012, CBA Promoter

SEQ ID NO: 11208 - DNA, 93 bp, Artificial Sequence; identical to SEQ ID NO: 11
  pOB1012, beta-actin Exon

SEQ ID NO: 11209 - DNA, 155 bp, Artificial Sequence; identical to SEQ ID NO: 9909
  pOB1012, Chimeric Intron

SEQ ID NO: 11210 - skipped

SEQ ID NO: 11211 - DNA, 10 bp, Artificial Sequence
  pOB1012, Kozak Sequence
tccaccatgc

SEQ ID NO: 11212 - DNA, 2241 bp, Artificial Sequence; identical to SEQ ID NO: 10512
  pOB1012, hABCD1/9nt

SEQ ID NO: 11213 - skipped

SEQ ID NO: 11214 - DNA, 197 bp, Artificial Sequence; identical to SEQ ID NO: 9914
  pOB1012, SV40 pA

SEQ ID NO: 11215 - skipped

SEQ ID NO: 11216 - DNA, 208 bp, Artificial Sequence; identical to SEQ ID NO: 9916
  pOB1012, bGH pA

SEQ ID NO: 11217 - skipped

SEQ ID NO: 11218 - DNA, 130 bp, Artificial Sequence; identical to SEQ ID NO: 10518
  pOB1012, 3'ITR

SEQ ID NO: 11219-11234 - skipped (16 entries)

SEQ ID NO: 11235 - DNA, 434 bp, Artificial Sequence; identical to SEQ ID NO: 206
  pOB1012, Total polyA

SEQ ID NO: 11236-11249 - skipped (14 entries)

SEQ ID NO: 11250 - DNA, 3996 bp, Artificial Sequence
  pOB1012, ITR-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctcgcgtattgggatagcttccaccatgccggtgctctctaggccccggccctggcgggggaacacgctgaagcgcacggccgtgctcctggccctcgcggcctatggagcccacaaagtctaccccttggtgcgccagtgcctggccccggctaggggtcttcaggcgcccgccggggagcccacgcaggaggcctccggggtcgcggcggccaaagctggcatgaaccgggtattcctgcagcggctcctctggctcctgcggctgctgttcccccgggtcctctgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgcggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctctggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgataactcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 11251-11259 - skipped (9 entries)

SEQ ID NO: 11260 - DNA, 4024 bp, Artificial Sequence
  pOB1012, rAAV vector genome
tggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctcgcgtattgggatagcttccaccatgccggtgctctctaggccccggccctggcgggggaacacgctgaagcgcacggccgtgctcctggccctcgcggcctatggagcccacaaagtctaccccttggtgcgccagtgcctggccccggctaggggtcttcaggcgcccgccggggagcccacgcaggaggcctccggggtcgcggcggccaaagctggcatgaaccgggtattcctgcagcggctcctctggctcctgcggctgctgttcccccgggtcctctgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgcggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctctggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgataactcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcca

SEQ ID NO: 11261-11270 - skipped (10 entries)

SEQ ID NO: 11271 - DNA, 3 bp, Artificial Sequence
  pOB1012, Terminator 1
tga

SEQ ID NO: 11272 - DNA, 3 bp, Artificial Sequence
  pOB1012, Terminator 2
taa

SEQ ID NO: 11273-11284 - skipped (12 entries)

SEQ ID NO: 11285 - DNA, 54 bp, Artificial Sequence; identical to SEQ ID NO: 9985
  pOB1012, Rabbit beta-globin exon

SEQ ID NO: 11286-11299 - skipped (14 entries)

SEQ ID NO: 11300 - DNA, 6209 bp, Artificial Sequence
  pOB1013, full plasmid
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctcgcgtattgggatagcttccaccatgccggtgctctctaggccccggccctggcgggggaacacgctgaagcgcacggccgtgctcctggccctcgcggcctatggagcccacaaagtctaccccttggtgcgccagtgcctggccccggctaggggtcttcaggcgcccgccggggagcccacgcaggaggcctccggggtcgcggcggccaaagctggcatgaaccgggtattcctgcagcggctcctctggctcctgcggctgctgttcccccgggtcctctgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgcggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctctggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgataactcgatcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgacgcggaacccctatttgtttatttttctaaatacattcaaatatgtatccgctcatgagacaataaccctgataaatgcttcaataatattgaaaaaggaagagtatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccctgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcctgcaggcag

SEQ ID NO: 11301 - DNA, 130 bp, Artificial Sequence; identical to SEQ ID NO: 10501
  pOB1013, 5'ITR

SEQ ID NO: 11302-11304 - skipped (3 entries)

SEQ ID NO: 11305 - DNA, 366 bp, Artificial Sequence; identical to SEQ ID NO: 9905
  pOB1013, CMV Enhancer

SEQ ID NO: 11306 - skipped

SEQ ID NO: 11307 - DNA, 278 bp, Artificial Sequence; identical to SEQ ID NO: 10
  pOB1013, CBA Promoter

SEQ ID NO: 11308 - DNA, 93 bp, Artificial Sequence; identical to SEQ ID NO: 11
  pOB1013, beta-actin Exon

SEQ ID NO: 11309 - DNA, 155 bp, Artificial Sequence; identical to SEQ ID NO: 9909
  pOB1013, Chimeric Intron

SEQ ID NO: 11310 - skipped

SEQ ID NO: 11311 - DNA, 10 bp, Artificial Sequence
  pOB1013, Kozak Sequence
tccaccatgc

SEQ ID NO: 11312 - DNA, 2241 bp, Artificial Sequence; identical to SEQ ID NO: 10512
  pOB1013, hABCD1/9nt

SEQ ID NO: 11313-11315 - skipped (3 entries)

SEQ ID NO: 11316 - DNA, 208 bp, Artificial Sequence; identical to SEQ ID NO: 9916
  pOB1013, bGH pA

SEQ ID NO: 11317 - skipped

SEQ ID NO: 11318 - DNA, 130 bp, Artificial Sequence; identical to SEQ ID NO: 10518
  pOB1013, 3'ITR

SEQ ID NO: 11319-11349 - skipped (31 entries)

SEQ ID NO: 11350 - DNA, 3776 bp, Artificial Sequence
  pOB1013, ITR-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctcgcgtattgggatagcttccaccatgccggtgctctctaggccccggccctggcgggggaacacgctgaagcgcacggccgtgctcctggccctcgcggcctatggagcccacaaagtctaccccttggtgcgccagtgcctggccccggctaggggtcttcaggcgcccgccggggagcccacgcaggaggcctccggggtcgcggcggccaaagctggcatgaaccgggtattcctgcagcggctcctctggctcctgcggctgctgttcccccgggtcctctgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgcggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctctggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgataactcgatcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 11351-11359 - skipped (9 entries)

SEQ ID NO: 11360 - DNA, 3804 bp, Artificial Sequence
  pOB1013, rAAV vector genome
tggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctcgcgtattgggatagcttccaccatgccggtgctctctaggccccggccctggcgggggaacacgctgaagcgcacggccgtgctcctggccctcgcggcctatggagcccacaaagtctaccccttggtgcgccagtgcctggccccggctaggggtcttcaggcgcccgccggggagcccacgcaggaggcctccggggtcgcggcggccaaagctggcatgaaccgggtattcctgcagcggctcctctggctcctgcggctgctgttcccccgggtcctctgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgcggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctctggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgataactcgatcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcca

SEQ ID NO: 11361-11370 - skipped (10 entries)

SEQ ID NO: 11371 - DNA, 3 bp, Artificial Sequence
  pOB1013, Terminator 1
tga

SEQ ID NO: 11372 - DNA, 3 bp, Artificial Sequence
  pOB1013, Terminator 2
taa

SEQ ID NO: 11373-11384 - skipped (12 entries)

SEQ ID NO: 11385 - DNA, 54 bp, Artificial Sequence; identical to SEQ ID NO: 9985
  pOB1013, Rabbit beta-globin exon

SEQ ID NO: 11386-11499 - skipped (114 entries)

SEQ ID NO: 11500 - DNA, 6353 bp, Artificial Sequence
  pOB1015, full plasmid
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagattcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgacgcggaacccctatttgtttatttttctaaatacattcaaatatgtatccgctcatgagacaataaccctgataaatgcttcaataatattgaaaaaggaagagtatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccctgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcctgcaggcag

SEQ ID NO: 11501 - DNA, 130 bp, Artificial Sequence; identical to SEQ ID NO: 10501
  pOB1015, 5'ITR

SEQ ID NO: 11502-11504 - skipped (3 entries)

SEQ ID NO: 11505 - DNA, 366 bp, Artificial Sequence; identical to SEQ ID NO: 9905
  pOB1015, CMV Enhancer

SEQ ID NO: 11506 - skipped

SEQ ID NO: 11507 - DNA, 278 bp, Artificial Sequence; identical to SEQ ID NO: 10
  pOB1015, CBA Promoter

SEQ ID NO: 11508 - DNA, 93 bp, Artificial Sequence; identical to SEQ ID NO: 11
  pOB1015, beta-actin Exon

SEQ ID NO: 11509 - DNA, 155 bp, Artificial Sequence; identical to SEQ ID NO: 9909
  pOB1015, Chimeric Intron

SEQ ID NO: 11510 - DNA, 117 bp, Artificial Sequence; identical to SEQ ID NO: 9910
  pOB1015, hABCD1 5' UTR

SEQ ID NO: 11511 - skipped

SEQ ID NO: 11512 - DNA, 2238 bp, Artificial Sequence
  pOB1015, hABCD1/3nt
atgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctga

SEQ ID NO: 11513 - DNA, 49 bp, Artificial Sequence; identical to SEQ ID NO: 9913
  pOB1015, hABCD1 3' UTR

SEQ ID NO: 11514-11515 - skipped (2 entries)

SEQ ID NO: 11516 - DNA, 208 bp, Artificial Sequence; identical to SEQ ID NO: 9916
  pOB1015, bGH pA

SEQ ID NO: 11517 - skipped

SEQ ID NO: 11518 - DNA, 130 bp, Artificial Sequence; identical to SEQ ID NO: 10518
  pOB1015, 3'ITR

SEQ ID NO: 11519-11549 - skipped (31 entries)

SEQ ID NO: 11550 - DNA, 3920 bp, Artificial Sequence
  pOB1015, ITR-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagattcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 11551-11559 - skipped (9 entries)

SEQ ID NO: 11560 - DNA, 3948 bp, Artificial Sequence
  pOB1015, rAAV vector genome
tggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagattcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcca

SEQ ID NO: 11561-11570 - skipped (10 entries)

SEQ ID NO: 11571 - DNA, 3 bp, Artificial Sequence
  pOB1015, Terminator 1
tga

SEQ ID NO: 11572-11584 - skipped (13 entries)

SEQ ID NO: 11585 - DNA, 54 bp, Artificial Sequence; identical to SEQ ID NO: 9985
  pOB1015, Rabbit beta-globin exon

SEQ ID NO: 11586-11699 - skipped (114 entries)

SEQ ID NO: 11700 - DNA, 6598 bp, Artificial Sequence
  pOB1017, full plasmid
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgacgcggaacccctatttgtttatttttctaaatacattcaaatatgtatccgctcatgagacaataaccctgataaatgcttcaataatattgaaaaaggaagagtatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccctgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcctgcaggcag

SEQ ID NO: 11701 - DNA, 130 bp, Artificial Sequence; identical to SEQ ID NO: 10501
  pOB1017, 5'ITR

SEQ ID NO: 11702-11704 - skipped (3 entries)

SEQ ID NO: 11705 - DNA, 366 bp, Artificial Sequence; identical to SEQ ID NO: 9905
  pOB1017, CMV Enhancer

SEQ ID NO: 11706 - skipped

SEQ ID NO: 11707 - DNA, 278 bp, Artificial Sequence; identical to SEQ ID NO: 10
  pOB1017, CBA Promoter

SEQ ID NO: 11708 - DNA, 93 bp, Artificial Sequence; identical to SEQ ID NO: 11
  pOB1017, beta-actin Exon

SEQ ID NO: 11709 - DNA, 155 bp, Artificial Sequence; identical to SEQ ID NO: 9909
  pOB1017, Chimeric Intron

SEQ ID NO: 11710 - DNA, 117 bp, Artificial Sequence; identical to SEQ ID NO: 9910
  pOB1017, hABCD1 5' UTR

SEQ ID NO: 11711 - skipped

SEQ ID NO: 11712 - DNA, 2238 bp, Artificial Sequence; identical to SEQ ID NO: 11512
  pOB1017, hABCD1/3nt

SEQ ID NO: 11713 - DNA, 49 bp, Artificial Sequence; identical to SEQ ID NO: 9913
  pOB1017, hABCD1 3' UTR

SEQ ID NO: 11714 - DNA, 197 bp, Artificial Sequence; identical to SEQ ID NO: 9914
  pOB1017, SV40 pA

SEQ ID NO: 11715 - skipped

SEQ ID NO: 11716 - DNA, 208 bp, Artificial Sequence; identical to SEQ ID NO: 9916
  pOB1017, bGH pA

SEQ ID NO: 11717 - skipped

SEQ ID NO: 11718 - DNA, 130 bp, Artificial Sequence; identical to SEQ ID NO: 10518
  pOB1017, 3'ITR

SEQ ID NO: 11719-11734 - skipped (16 entries)

SEQ ID NO: 11735 - DNA, 434 bp, Artificial Sequence; identical to SEQ ID NO: 206
  pOB1017, Total polyA

SEQ ID NO: 11736-11749 - skipped (14 entries)

SEQ ID NO: 11750 - DNA, 4165 bp, Artificial Sequence
  pOB1017, ITR-ITR
ctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcag

SEQ ID NO: 11751-11759 - skipped (9 entries)

SEQ ID NO: 11760 - DNA, 4193 bp, Artificial Sequence
  pOB1017, rAAV vector genome
tggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctgcggccgcaaccgtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagctagagcctctgctaaccatgttcatgccttcttctttttcctacagctcctgggcaacgtgctggttattgtgctgtctcatcattttggcaaagaattcctcgaagatccgaaggggttcaagctttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtacgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggacgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgttagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaattctgcagatatccagcacagtggcggccgctcgagctagcggccgctctagaaagagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttagtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatcgtgcggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggcca

SEQ ID NO: 11761-11770 - skipped (10 entries)

SEQ ID NO: 11771 - DNA, 3 bp, Artificial Sequence
  pOB1017, Terminator 1
tga

SEQ ID NO: 11772-11784 - skipped (13 entries)

SEQ ID NO: 11785 - DNA, 54 bp, Artificial Sequence; identical to SEQ ID NO: 9985
  pOB1017, Rabbit beta-globin exon

What is claimed is:

1. A recombinant adeno-associated viral (AAV) vector comprising:
   (a) an AAV9 capsid; and
   (b) a recombinant AAV vector genome comprising, in a 5' to 3' direction, a truncated 5' AAV2 inverted terminal repeat sequence, a cytomegalovirus enhancer, a chicken beta-actin promoter, a beta-actin exon, a chimeric intron, a rabbit beta-globin exon, a human ATP-binding cassette, sub-family D, member 1 (ABCD1) 5' untranslated region, a human ABCD1 coding sequence, a human ABCD1 3' untranslated region, an SV40 polyadenylation signal sequence, a bovine growth hormone polyadenylation signal sequence, and a truncated 3' AAV2 inverted terminal repeat sequence,
   wherein the recombinant AAV vector genome does not comprise a woodchuck post-transcriptional regulatory element.

2. The recombinant AAV vector of claim 1, wherein the truncated 5' AAV2 inverted terminal repeat sequence comprises the sequence of SEQ ID NO: 11001.

3. The recombinant AAV vector of claim 1, wherein the cytomegalovirus enhancer comprises the sequence of SEQ ID NO: 11005.

4. The recombinant AAV vector of claim 1, wherein the chicken beta-actin promoter comprises the sequence of SEQ ID NO: 11007.

5. The recombinant AAV vector of claim 1, wherein the beta-actin exon comprises the sequence of SEQ ID NO: 11008.

6. The recombinant AAV vector of claim 1, wherein the chimeric intron comprises the sequence of SEQ ID NO: 11009.

7. The recombinant AAV vector of claim 1, wherein the rabbit beta-globin exon comprises the sequence of SEQ ID NO: 11085.

8. The recombinant AAV vector of claim 1, wherein the human ABCD1 5' untranslated region comprises the sequence of SEQ ID NO: 11010.

9. The recombinant AAV vector of claim 1, wherein the human ABCD1 coding sequence comprises the sequence of SEQ ID NO: 11012.

10. The recombinant AAV vector of claim 1, wherein the human ABCD1 3' untranslated region comprises the sequence of SEQ ID NO: 11013.

11. The recombinant AAV vector of claim 1, wherein the SV40 polyadenylation signal comprises the sequence of SEQ ID NO: 11014.

12. The recombinant AAV vector of claim 1, wherein the bovine growth hormone polyadenylation signal comprises the sequence of SEQ ID NO: 11016.

13. The recombinant AAV vector of claim 1, wherein the truncated 3' AAV2 inverted terminal repeat sequence comprises the sequence of SEQ ID NO: 11018.

14. A recombinant AAV vector comprising an AAV9 capsid and a recombinant AAV vector genome comprising the sequence of SEQ ID NO: 11050.

15. A recombinant AAV vector comprising an AAV9 capsid and a recombinant AAV vector genome comprising the sequence of SEQ ID NO: 11060.

* * * * *